(12) United States Patent
Bazyk et al.

(10) Patent No.: US 12,286,459 B2
(45) Date of Patent: Apr. 29, 2025

(54) INSECTICIDAL TOXIN RECEPTORS AND METHODS OF USE

(71) Applicant: PIONEER HI-BRED INTERNATIONAL, INC., Johnston, IA (US)

(72) Inventors: Claire Marie Bazyk, Fremont, CA (US); Catherine J Clark, Altoona, IA (US); Ruth Cong, Palo Alto, CA (US); James M Hasler, Danville, IN (US); Jingtong Hou, San Pablo, CA (US); Naga Kishore Kakani, Fremont, CA (US); Deirdre Kapka-Kitzman, Ankeny, IA (US); Song Leng, Castro Valley, CA (US); John P Mathis, Johnston, IA (US); Mark Edward Nelson, Waukee, IA (US); Takashi Yamamoto, Dublin, CA (US)

(73) Assignee: PIONEER HI-BRED INTERNATIONAL, INC., Johnston, IA (US)

( * ) Notice: Subject to any disclaimer, the term of this patent is extended or adjusted under 35 U.S.C. 154(b) by 1110 days.

(21) Appl. No.: 17/266,318

(22) PCT Filed: Aug. 2, 2019

(86) PCT No.: PCT/US2019/044771
§ 371 (c)(1),
(2) Date: Feb. 5, 2021

(87) PCT Pub. No.: WO2020/036747
PCT Pub. Date: Feb. 20, 2020

(65) Prior Publication Data
US 2022/0380418 A1 Dec. 1, 2022

Related U.S. Application Data

(60) Provisional application No. 62/718,232, filed on Aug. 13, 2018.

(51) Int. Cl.
| | |
|---|---|
| *C07K 14/435* | (2006.01) |
| *C07K 16/28* | (2006.01) |
| *C12N 15/90* | (2006.01) |
| *C12Q 1/6888* | (2018.01) |
| *G01N 33/68* | (2006.01) |

(52) U.S. Cl.
CPC ........ *C07K 14/43563* (2013.01); *C07K 16/28* (2013.01); *C12N 15/902* (2013.01); *C12Q 1/6888* (2013.01); *G01N 33/68* (2013.01); *C12Q 2600/156* (2013.01); *C12Q 2600/158* (2013.01); *G01N 2333/43552* (2013.01)

(58) Field of Classification Search
CPC ................................................ C07K 14/43563
See application file for complete search history.

(56) References Cited

U.S. PATENT DOCUMENTS

| | | |
|---|---|---|
| 9,970,926 B1 | 5/2018 | Kraft et al. |
| 2013/0097728 A1 | 4/2013 | Heinrichs et al. |

FOREIGN PATENT DOCUMENTS

| | | |
|---|---|---|
| WO | 2011075588 A1 | 6/2011 |
| WO | 2012083099 A1 | 6/2012 |
| WO | 2016/126417 A1 | 8/2016 |
| WO | 2018140859 A2 | 8/2018 |

OTHER PUBLICATIONS

Database UniProt EBI Accession No. Uniprot: A0A2H1WL33, Apr. 25, 2018 (Apr. 25, 2018); XP002795249.
International Search Report and Written Opinion for International Application No. PCT/US2019/044771, Mailed Aug. 2, 2019.
Willcoxon M.I., et al., "A high-throughput, In-vitro Assay for Bacillus Thuringiensis Insecticidal Proteins," Journal of Biotechnology, 2016, vol. 217, pp. 72-81.
International Preliminary Report on Patentability for International Application No. PCT/US2019/044771, mailed Feb. 25, 2021, 11 Pages.
International Search Report and Written Opinion for International Application No. PCT/US2019/044771, mailed Jan. 27, 2020, 19 Pages.

*Primary Examiner* — Suzanne M Noakes

(57) ABSTRACT

The disclosure relates to insecticidal toxin resistance management and screening of novel insecticidal toxins. One embodiment relates to the isolation, characterization, compositions, and methods of use relating to polynucleotides encoding novel insecticidal toxin receptors and the polypeptides encoded thereby. The polynucleotides and polypeptides are useful in identifying or designing novel insecticidal toxin receptor ligands including novel insecticidal toxins.

1 Claim, 4 Drawing Sheets
Specification includes a Sequence Listing.

INSECTICIDAL TOXIN RECEPTORS AND METHODS OF USE

CROSS-REFERENCE TO RELATED APPLICATIONS

This application claims the benefit of U.S. Provisional Application No. 62/718,232, filed Aug. 13, 2018, which is hereby incorporated herein in its entirety by reference.

REFERENCE TO SEQUENCE LISTING SUBMITTED ELECTRONICALLY

The official copy of the sequence listing is submitted electronically via EFS-Web as an ASCII formatted sequence listing with a file named "7793_Sequence_Listing.txt" created on Aug. 10, 2018, and having a size of 2,531 kilobytes and is filed concurrently with the specification. The sequence listing contained in this ASCII formatted document is part of the specification and is herein incorporated by reference in its entirety.

FIELD

The disclosure relates to insecticidal toxin resistance management and screening of novel insecticidal toxins. One embodiment relates to the isolation, characterization, compositions, and methods of use relating to polynucleotides encoding novel insecticidal toxin receptors and the polypeptides encoded thereby. The polynucleotides and polypeptides are useful in identifying or designing novel insecticidal toxin receptor ligands including novel insecticidal toxins.

BACKGROUND

Insect pests are a major factor in the loss of the world's agricultural crops. For example, armyworm feeding, black cutworm damage, or European corn borer damage can be economically devastating to agricultural producers. Insect pest-related crop loss from attacks on field and sweet corn alone has reached about one billion dollars a year in damage and control expenses.

Traditionally, growers have used chemical pesticides as a means to control agronomically important pests. The introduction of transgenic plants carrying the delta-endotoxin from *Bacillus thuringiensis* (Bt) afforded a non-chemical method of control. Bt toxins have traditionally been categorized by their specific toxicity towards specific insect categories.

Lepidopteran insects cause considerable damage to maize crops throughout North America and the world. One of the leading pests is *Ostrinia nubulalis*, commonly called the European corn borer (ECB). Genes encoding the crystal proteins Cry1Ab and Cry1Ac from Bt have been introduced into maize as a means of ECB control as well as other pests. These transgenic maize hybrids have been effective in control of ECB. However, developed resistance to Bt toxins presents a challenge in pest control.

Identification of the plant pest binding polypeptides for Bt toxins are useful for investigating Bt toxin-Bt toxin receptor interactions, selecting and designing improved toxins or other insecticides, developing novel insecticides, and screening for resistance or other resistance management strategies and tools.

BRIEF SUMMARY

Compositions and methods for modulating susceptibility of a cell to toxins are provided. The compositions include toxin receptor polypeptides and fragments and variants thereof, from the Lepidopteran insects corn earworm (CEW, *Helicoverpa zea*) and European corn borer (ECB, *Ostrinia nubilalis*), fall armyworm (FAW, *Spodoptera frugiperda*), cabbage looper (*Trichoplusia ni*), black cutworm (*Agrotis ipsilon*) and soybean looper (SBL, *Chrysodeixis includens*) and Coleopteran insects western corn rootworm (*Diabrotica virgifera virgifera*) and *Diabrotica speciosa*. Nucleic acids encoding the polypeptides, antibodies specific to the polypeptides, and nucleic acid constructs for expressing the polypeptides in cells of interest are also provided.

The methods provided here are useful for investigating the structure-function relationships of toxin receptors; investigating toxin-receptor interactions; elucidating the mode of action of toxins; screening and identifying novel toxin receptor ligands including novel insecticidal toxins; designing and developing novel toxin receptor ligands; and creating insects or insect colonies with altered susceptibility to insecticidal toxins.

The disclosure provides for isolated nucleic acid molecules comprising nucleotide sequences encoding polypeptides having toxin binding activity shown in SEQ ID NO: 180-314; or the respective encoding polynucleotide sequences of SEQ ID NO: 45-179. Further provided are fragments and variant polypeptides described herein. Compositions may include nucleic acid molecules encoding sequences for polypeptides having toxin binding activity, vectors comprising those nucleic acid molecules, and host cells comprising the vectors.

The disclosure provides methods and composition relating to genetically edited insect cells, insects, or insect colonies, wherein the genetically edited insect cell, insect, or insect colony is resistant to an insecticidal toxin. In some embodiments, the insect cell, insect, or insect cell colony is susceptible to the insecticidal toxin prior to any genetic editing. In some embodiments, a native insecticidal toxin receptor is genetically edited. In certain embodiments, the native insecticidal receptor comprises as sequence as set forth in any one of SEQ ID NOs: 180-314.

The compositions and methods provided herein are also useful for managing toxin resistance in plant pests, for monitoring of toxin resistance in plant pests, and for protecting plants against damage by plant pests.

DETAILED DESCRIPTION

Figure 1:
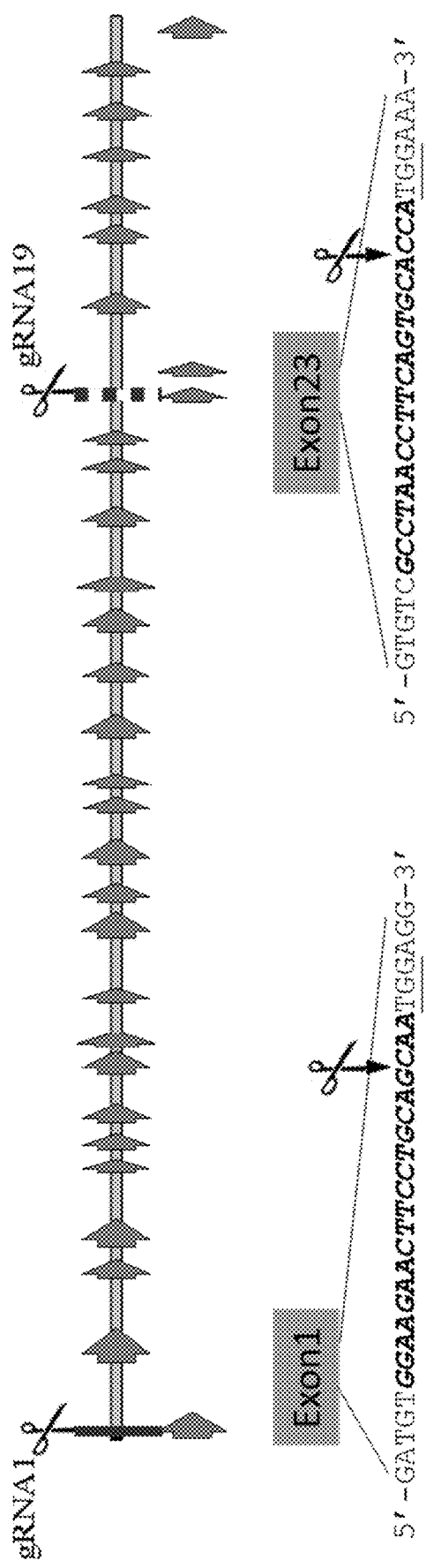
FIG. 1: Shows CRISPR/Cas9 targeting of FAW insecticidal toxin receptor ABCA3 (genomic DNA set forth in SEQ ID NO: 2, and the protein sequence set forth in SEQ ID NO: 180) by sgRNA1 (SEQ ID NO: 335) and sgRNA19 (SEQ ID NO: 336). The sgRNA target for sgRNA1 and sgRNA19 sequence are bold and italicized, and the PAM sequence is underlined for each.
Figure 2:
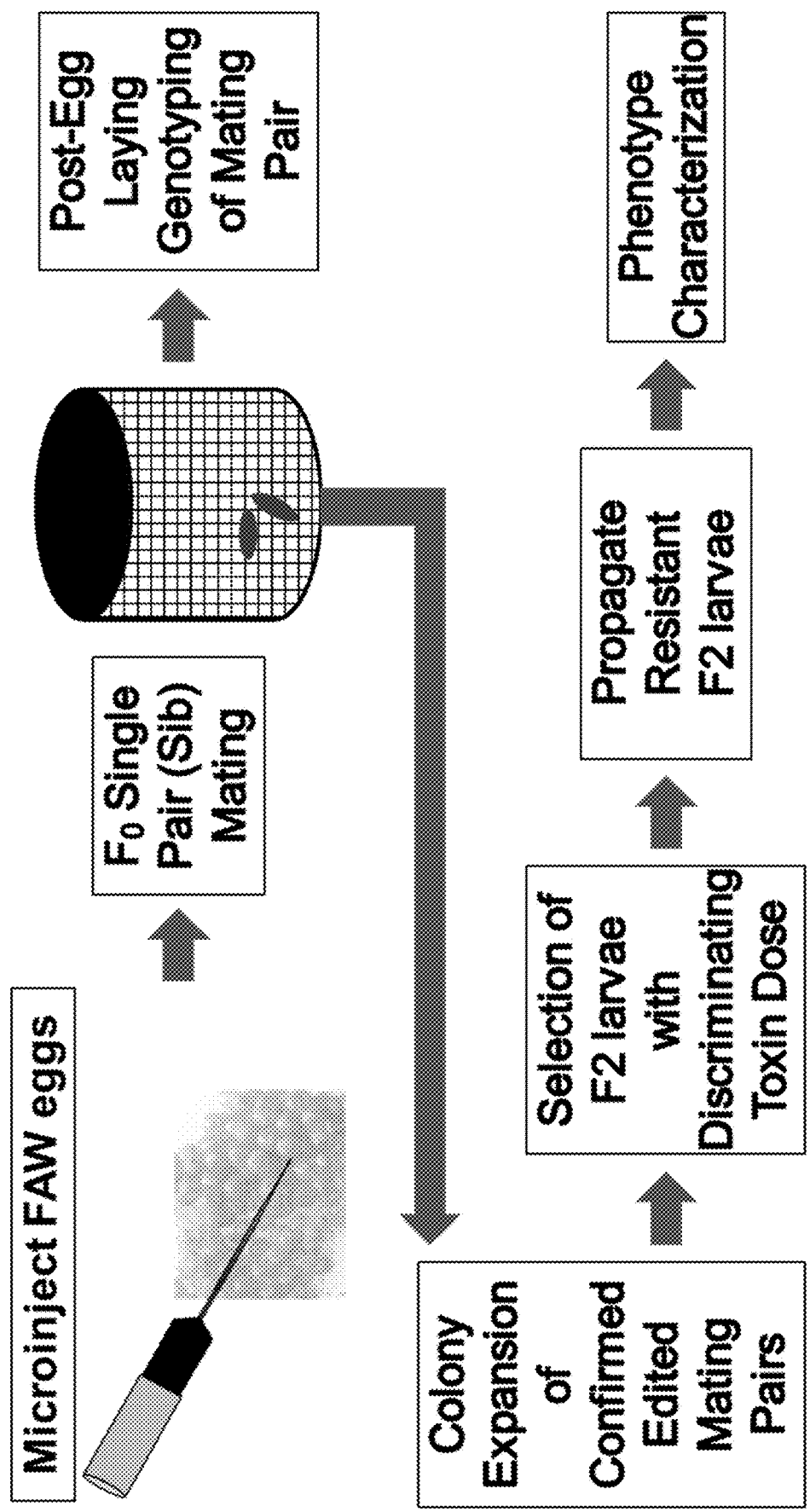
FIG. 2: Shows the sample egg microinjection for F0 sampling.
Figure 3:
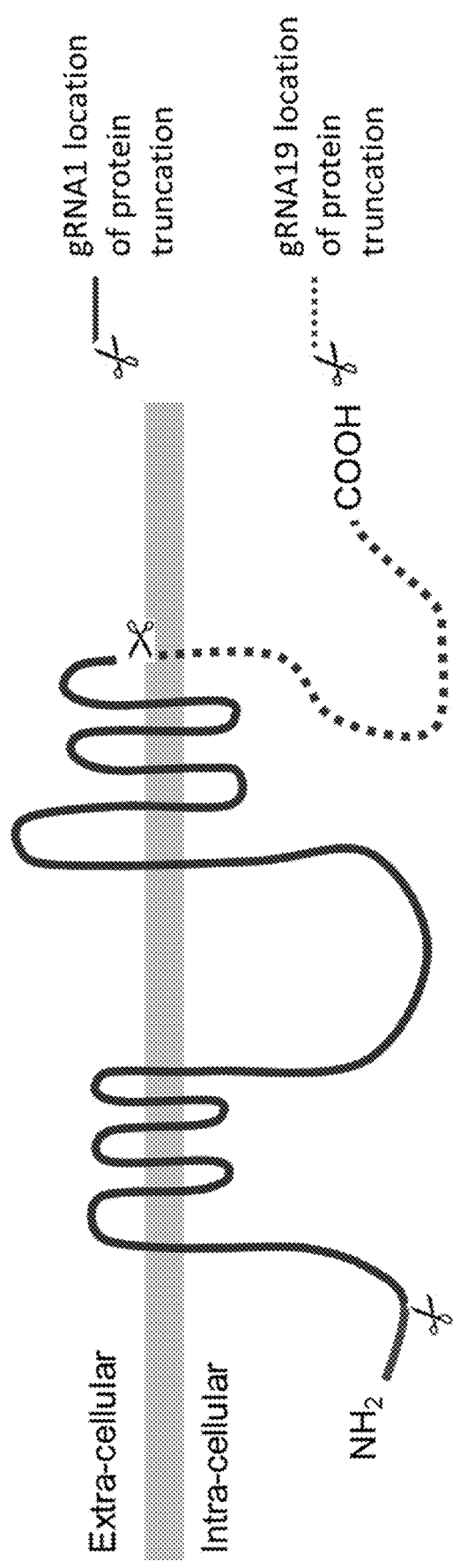
FIG. 3: Shows a representation of the indels resulting in early protein termination of ABCA3 (SEQ ID NO: 180) by sgRNA1 and sgRNA19.
Figure 4:
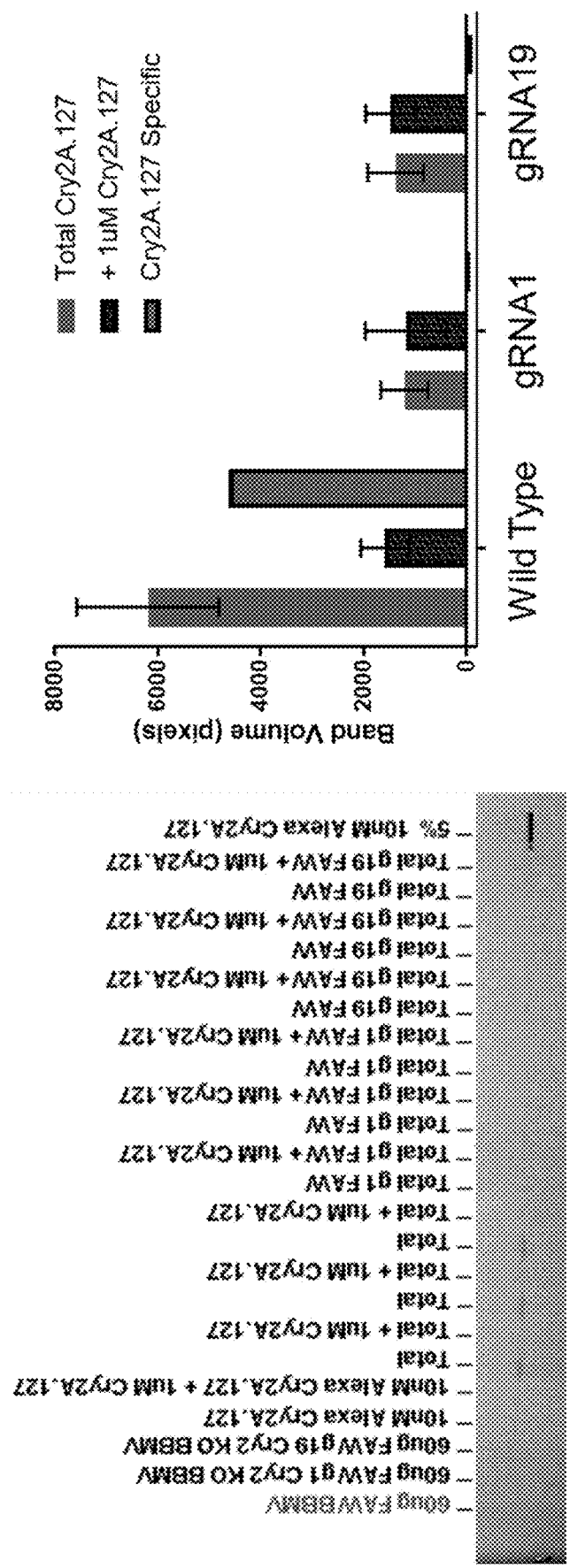
FIG. 4: Shows binding of IP2.127 is lost in both sgRNA1 and sgRNA19 edited insect midgut tissue.

As used herein the singular forms "a", "and", and "the" include plural referents unless the context clearly dictates otherwise. Thus, for example, reference to "a cell" includes a plurality of such cells and reference to "the protein"

includes reference to one or more proteins and equivalents thereof, and so forth. All technical and scientific terms used herein have the same meaning as commonly understood to one of ordinary skill in the art to which this disclosure belongs unless clearly indicated otherwise.

The embodiments provided herein are directed to receptor polypeptides having toxin binding activity, the receptors being derived from the orders Lepidoptera and Coleoptera. Receptor polypeptides disclosed herein are derived from *Helicoverpa zea, Trichoplusia ni, Agrotis Ipsilon, Spodoptera frugiperda,* and *Chrysodeixis includens, Ostrinia nubilalis, Diabrotica virgifera virgifera,* and *Diabrotica speciosa* and have toxin binding activity. In some embodiments, the receptors have Bt binding activity. In other embodiments, the receptors have non-Bt toxin binding activity.

Accordingly, one embodiment provides for isolated nucleic acid molecules comprising nucleotide sequences encoding polypeptides having toxin binding activity shown in SEQ ID NOs: 180-314 as well as amino acid substitutions, deletions, insertions, fragments thereof, and combinations thereof; or the respective encoding polynucleotide sequences of SEQ ID NOs: 45-179. Compositions include nucleic acid molecules encoding sequences for polypeptides having toxin binding activity, vectors comprising those nucleic acid molecules, and host cells comprising the vectors. Further provided are fragments and variant polypeptides described herein. Also provided are isolated or recombinant polypeptides having toxin binding activity of SEQ ID NOs: 180-314, as well as amino acid substitutions, deletions, insertions, fragments thereof and combinations thereof.

One embodiment encompasses isolated or substantially purified nucleic acids or polypeptide compositions. An "isolated" or "purified" nucleic acid molecule or polypeptide, or biologically active portion thereof, is substantially free of other cellular material, or culture medium when produced by recombinant techniques, or substantially free of chemical precursors or other chemicals when chemically synthesized. An "isolated" nucleic acid can be free of sequences (preferably polypeptide encoding sequences) that naturally flank the nucleic acid (i.e., sequences located at the 5' and 3' ends of the nucleic acid) in the genomic DNA of the organism from which the nucleic acid is derived. For example, in one embodiment, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. One embodiment contemplates polypeptide that is substantially free of cellular material including preparations of polypeptide having less than about 30%, 20%, 10%, 5%, (by dry weight) of contaminating polypeptide. When the polypeptide or biologically active portion thereof is recombinantly produced, the culture medium may represent less than about 30%, 20%, 10%, or 5% (by dry weight) of chemical precursors or non-polypeptide-of-interest chemicals.

In another embodiment, polypeptide preparations may contain contaminating material that does not interfere with the specific desired activity of the polypeptide. The compositions also encompass fragments and variants of the disclosed nucleotide sequences and the polypeptides encoded thereby.

Polynucleotide compositions are useful for, among other uses, expressing the receptor polypeptides, or fragments thereof, in cells of interest to produce cellular or isolated preparations of said polypeptides for investigating the structure-function and/or sequence-function relationships of toxin receptors, evaluating toxin-receptor interactions, elucidating the mode of action of toxins, screening test compounds to identify novel toxin receptor ligands including novel insecticidal toxins, and designing and developing novel toxin receptor ligands including novel insecticidal toxins.

The isolated polynucleotides encoding the receptor polypeptides of the embodiment may be expressed in a cell of interest; and the toxin receptor polypeptides produced may be utilized in intact cell or in-vitro receptor binding assays, and/or intact cell toxicity assays.

As used herein, a "Bt toxin" refers to genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Members of these classes of *B. thuringiensis* insecticidal proteins include, but are not limited to, Cry proteins well known to one skilled in the art (see, Crickmore, et al., "*Bacillus thuringiensis* toxin nomenclature" (2011), at btnomenclature.info which can be accessed on the world-wide web using the "www" prefix).

By "cell of interest" is intended any cell in which expression of the polypeptides disclosed herein is desired. Cells of interest include, but are not limited to mammalian, avian, insect, plant, bacteria, fungi and yeast cells. Cells of interest include but are not limited to cultured cell lines, primary cell cultures, cells in vivo, and cells of transgenic or genetically modified or edited organisms.

As used herein, a "modified" or "altered" sequence refers to a sequence that differs from the wildtype sequence. In one embodiment, a modified or altered polynucleotide sequence differs from SEQ ID NOs: 45-179. In another embodiment, a modified or altered amino acid sequence differs from SEQ ID NO: 180-314. In one embodiment, a modification or alteration in a sequence can be screened to determine an altered susceptibility to a toxin. The methods embodied contemplate the use of polypeptides and polynucleotides disclosed herein in receptor binding and/or toxicity assays to screen test compounds to identify novel toxin receptor ligands, including receptor agonists and antagonists, or to screen for resistance. Test compounds may include molecules available from diverse libraries of small molecules created by combinatorial synthetic methods. Test compounds also may include, but are not limited to, antibodies, binding peptides, and other small molecules designed or deduced to interact with the receptor polypeptides of the embodiment. Test compounds may also include peptide fragments of the receptor, anti-receptor antibodies, anti-idiotypic antibodies mimicking one or more receptor binding domains of a toxin, binding peptides, chimeric peptides, and fusion, or heterologous polypeptides, produced by combining two or more toxins or fragments thereof, such as extracellular portions of the receptors disclosed herein and the like. Ligands identified by the screening methods of the embodiment include potential novel insecticidal toxins, the insecticidal activity of which can be determined (see for example, U.S. Pat. Nos. 5,407,454, 5,986,177, and 6,232, 439).

In one embodiment, the methods relate to isolating receptors of insect midgut toxins comprising dissecting an insect midgut tissue; performing a membrane enrichment step on the insect midgut tissue, such as a BBMV preparation;

performing an in-solution binding assay on the enriched membrane with an insect toxin; and performing an affinity purification, wherein the toxin is the affinity purification target. In another embodiment, performing a membrane enrichment step may be performed on a whole insect. In another embodiment, the affinity purification may be performed prior to the in-solution binding step. In one embodiment, the affinity purification target is the insect toxin. In another embodiment, the affinity purification target is the receptor polypeptide.

The embodiment provides methods for screening ligands that bind to the polypeptides disclosed herein. Both the polypeptides and fragments thereof (for example, toxin binding peptides) may be used in screening assays for compounds that bind to receptor peptides and exhibit desired binding characteristics. Desired binding characteristics include, but are not limited to binding affinity, binding site specificity, association and dissociation rates, and the like. The screening assays may be conducted in intact cells or in in vitro assays which include exposing a ligand binding domain to a sample ligand and detecting the formation of a ligand-binding polypeptide complex. The assays may be direct ligand-receptor binding assays, ligand competition assays, or indirect assays designed to measure impact of binding on transporter function, for example, ATP hydrolysis, conformational change, or solute transport. In some embodiments, a modified or edited receptor may be used in screening assays for compounds that bind to a modified or edited receptor peptide and exhibit desired binding characteristics.

The methods comprise providing at least one toxin receptor polypeptide disclosed herein, contacting the polypeptide with a sample and a control ligand under conditions promoting binding, and determining binding characteristics of sample ligands, relative to control ligands. For in vitro binding assays, a polypeptide may be provided as isolated, lysed, or homogenized cellular preparations. Isolated polypeptides may be provided in solution, or immobilized to a matrix. Methods for immobilizing polypeptides include, but are not limited to, construction and use of fusion polypeptides with commercially available high affinity ligands. For example, GST fusion proteins can be adsorbed onto glutathione sepharose beads (Sigma Chemical, St. Louis, MO) or glutathione derivatized microtitre plates. The polypeptides may also be immobilized using biotin and streptavidin, chemical conjugation (linking) of polypeptides to a matrix, or by using antibodies to the polypeptides. Alternatively, the polypeptides may be provided in intact cell binding assays in which the polypeptides are generally expressed as cell surface toxin receptors.

The disclosure provides methods utilizing intact cell toxicity assays to screen for ligands that bind to the receptor polypeptides disclosed herein and confer toxicity upon a cell of interest expressing the polypeptide in the presence of an insecticidal toxin. A ligand selected by this screening is a potential insecticidal toxin to insects expressing a receptor polypeptide, a modified or edited receptor polypeptide, or a fragment thereof. The insect specificity of a particular toxin may be determined by the presence of the receptor in specific insect species. Binding of the toxins may be specific for the receptor of some insect species and while insignificant or nonspecific for other variant receptors. The toxicity assays include exposing, in intact cells expressing a polypeptide of the embodiment, the toxin binding domain of a polypeptide to a sample ligand and detecting the toxicity effected in the cell expressing the polypeptide. By "toxicity" is intended the decreased viability of a cell. By "viability" is intended the ability of a cell to proliferate and/or differentiate and/or maintain its biological characteristics in a manner characteristic of that cell in the absence of a particular cytotoxic agent.

In one embodiment, the methods comprise providing at least one cell surface toxin receptor polypeptide comprising any one of SEQ ID NOs: 180-314 or an extracellular toxin binding domain thereof, contacting the receptor polypeptide with a sample and a control ligand under conditions promoting binding, and determining the viability of the cell expressing the cell surface toxin receptor polypeptide, relative to the control ligand. By "contacting" is intended that the sample and control agents are presented to the intended ligand binding site of the polypeptides of the embodiment. By "conditions promoting binding" is intended any combination of physical and biochemical conditions that enables a ligand of the polypeptides of the embodiment to bind the intended polypeptide over background levels. In this aspect, commercially available methods for studying protein-protein interactions, such as yeast and/or bacterial two-hybrid systems may also be used. Two-hybrid systems are available from, for example, Clontech (Palo Alto, Ca) or Display Systems Biotech Inc. (Vista, Ca).

The compositions and screening methods disclosed herein are useful for designing and developing novel toxin receptor ligands including novel insecticidal toxins. Various candidate ligands; ligands screened and characterized for binding, toxicity, and species specificity; and/or ligands having known characteristics and specificities may be linked or modified to produce novel ligands having particularly desired characteristics and specificities. The methods described herein for assessing binding, toxicity and insecticidal activity may be used to screen and characterize the novel ligands.

The compositions and screening methods disclosed herein are useful for designing and developing novel toxin receptor-ligand complexes, wherein both the receptor and ligand are expressed in the same cell. By "complexes" is intended that the association of the receptor to the ligand is sufficient to prevent other interactions to the ligand in the cell. The receptor may be receptors described herein, or variants or fragments thereof. Also, the receptor may be a heterologous polypeptide, retaining biological activity of the receptor polypeptides described herein.

In one embodiment, the sequences encoding the receptors, and variants and fragments thereof, are used with yeast and bacterial two-hybrid systems to screen for toxins of interest (for example, more specific and/or more potent toxins), or for insect molecules that bind the receptor and can be used in developing novel insecticides.

By "linked" is intended that a covalent bond is produced between two or more molecules. Methods that may be used for modification and/or linking of polypeptide ligands such as toxins, include mutagenic and recombinogenic approaches including, but not limited to, site-directed mutagenesis, chimeric polypeptide construction, and DNA shuffling. Polypeptide modification methods also include methods for covalent modification of polypeptides. The term "operably linked" as used herein refers to a functional linkage, for example between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame.

The compositions and screening methods are useful for targeting ligands to cells expressing receptor or modified receptor polypeptides. For targeting, secondary polypeptides, and/or small molecules which do not bind the receptor polypeptides are linked with one or more primary ligands which bind the receptor polypeptides disclosed herein, including but not limited to a Cry2A toxin, and more particularly an IP2.127 toxin, a variant, or a fragment thereof. (See SEQ ID NOs: 133 and 134 of U.S. Pat. No. 7,208,474, herein incorporated by reference). By linkage, any polypeptide and/or small molecule linked to a primary ligand may be targeted to the receptor polypeptide, and thereby to a cell expressing the receptor polypeptide; wherein the ligand binding site is available at the extracellular surface of the cell.

For expression of the toxin receptor polypeptides of SEQ ID NOs: 180-314, variants, or fragments in a cell of interest, the toxin receptor sequences may be provided in expression cassettes. The cassette may include 5' and 3' regulatory sequences operably linked to a toxin receptor sequence. The cassette may additionally contain at least one additional gene to be cotransformed into the organism. Alternatively, the additional gene(s) may be provided on multiple expression cassettes.

Such an expression cassette may be provided with a plurality of restriction sites for insertion of the toxin receptor sequence to be under the transcriptional regulation of the regulatory regions. The expression cassette may additionally contain selectable marker genes.

The expression cassette may include in the 5'-3' direction of transcription, a transcriptional and translational initiation region (i.e., a promoter), a toxin receptor nucleotide sequence, and a transcriptional and translational termination region (i.e., termination region) functional in host cells. The transcriptional initiation region, the promoter, may be native or analogous, or foreign or heterologous to the plant host and/or to the toxin receptor sequence. Additionally, the promoter may be the natural sequence or alternatively a synthetic sequence. Where a sequence is "foreign" or "heterologous", it is intended that the sequence is not the native or naturally occurring. As used herein, a chimeric gene comprises a coding sequence operably linked to a transcription initiation region that is heterologous to the coding sequence. As used herein, a modified or edited sequence is a heterologous sequence.

Heterologous promoters or native promoter sequences may be used in construct design. Such constructs may change expression levels of a toxin receptor in a cell of interest, resulting in alteration of the phenotype of the cell.

The termination region may be native with the transcriptional initiation region, may be native with the operably linked DNA sequence of interest, may be native with the plant host, or may be derived from another source (i.e., foreign or heterologous to the promoter, the toxin receptor sequence of interest, the plant host, or any combination thereof). Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Where appropriate, a gene may be optimized for increased expression in a particular transformed cell of interest. That is, the genes may be synthesized using host cell-preferred codons for improved expression.

Additional sequence modifications may enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures.

The expression cassettes may additionally contain 5' leader sequences in the expression cassette construct. Such leader sequences can act to enhance translation. Translation leaders include: picornavirus leaders, for example, EMCV leader (encephalomyocarditis 5' noncoding region; Elroy-Stein et al. (1989) *PNAS USA* 86:6126-6130); potyvirus leaders, for example, TEV leader (tobacco etch virus; Allison et al. (1986); MDMV leader (maize dwarf mosaic virus), and human immunoglobulin heavy-chain binding polypeptide (BiP), (Macejak et al. (1991) *Nature* 353:90-94); untranslated leader from the coat polypeptide mRNA of alfalfa mosaic virus (AMV RNA 4); Jobling et al. (1987) *Nature* 325:622-625); tobacco mosaic virus leader (TMV; Gallie et al. (1989) in *Molecular Biology of RNA*, ed. Cech (Liss, New York), pp. 237-256); and maize chlorotic mottle virus leader (MCMV; Lommel et al. (1991) *Virology* 81:382-385). See also, Della-Cioppa et al. (1987) *Plant Physiol.* 84:965-968. Other methods to enhance translation can also be utilized, for example, introns, and the like.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

Using the nucleic acids disclosed herein, the polypeptides may be expressed in any cell of interest, the particular choice of the cell depending on factors such as the level of expression and/or receptor activity desired. Cells of interest include, but are not limited to mammalian, plant, insect, bacteria, and yeast host cells. The choice of promoter, terminator, enhancers, and other expression vector components will also depend on the cell chosen. The cells produce the protein in a non-natural condition (e.g., in quantity, composition, location, and/or time), because they have been genetically altered through human intervention to do so.

The vector is selected to allow introduction into the appropriate host cell. Bacterial vectors are typically of plasmid or phage origin. Appropriate bacterial cells are infected with phage vector particles or transfected with naked phage vector DNA. If a plasmid vector is used, the bacterial cells are transfected with the plasmid vector DNA. Expression systems for expressing a protein of the present embodiment are available using *Bacillus* sp. and *Salmonella*. See, Palva et al. (1983) *Gene* 22:229-235 and Mosbach et al. (1983) *Nature* 302:543-545.

A variety of eukaryotic expression systems such as yeast, insect cell lines, plant and mammalian cells may be used for expression. The sequences disclosed herein may be expressed in these eukaryotic systems. In some embodiments, transformed/transfected plant cells are employed as expression systems for production of the receptor proteins.

The sequences encoding polypeptides disclosed herein may also be ligated to various expression vectors for use in transfecting cell cultures of, for instance, mammalian, insect, or plant origin. Illustrative of cell cultures useful for the production of the peptides are mammalian cells. Mammalian cell systems often will be in the form of monolayers of cells although mammalian cell suspensions may also be used. A number of suitable host cell lines capable of expressing intact proteins have been developed in the art, and include the COS, HEK293, BHK21, and CHO cell lines. Expression vectors for these cells can include expression control sequences, such as an origin of replication, a promoter (e.g., the CMV promoter, the HSV tk promoter or pgk (phosphoglycerate kinase promoter)), an enhancer (Queen et al. (1986) *Immunol. Rev.* 89:49), and necessary processing information sites, such as ribosome binding sites, RNA splice sites, polyadenylation sites (e.g., an SV40 large T Ag poly A addition site), and transcriptional terminator sequences. Other animal cells useful for production of proteins are available, for instance, from the American Type Culture Collection Catalogue of Cell Lines and Hybridomas (7th edition, 1992). One example of mammalian cells for expression of a toxin receptor and assessing toxin cytotoxicity mediated by the receptor, is human embryonic kidney 293 cells. See U.S. Pat. No. 5,693,491, herein incorporated by reference.

Appropriate vectors for expressing polypeptides disclosed herein in insect cells are usually derived from the SF9 baculovirus. Suitable insect cell lines include mosquito larvae, silkworm, armyworm, moth and *Drosophila* cell lines such as a Schneider cell line (Schneider et al. (1987) *J. Embryol. Exp. Morphol.* 27: 353-365). One embodiment contemplates a cell-free polypeptide expression system.

As with yeast, when higher animal or plant host cells are employed, polyadenylation or transcription terminator sequences are typically incorporated into the vector. An example of a terminator sequence is the polyadenylation sequence from the bovine growth hormone gene. Sequences for accurate splicing of the transcript may also be included. An example of a splicing sequence is the VP1 intron from SV40 (Sprague et al. (1983) *J. Virol.* 45:773-781). Additionally, gene sequences to control replication in the host cell may be incorporated into the vector such as those found in bovine papilloma virus-type vectors. Saveria-Campo, M., Bovine Papilloma Virus DNA a Eukaryotic Cloning Vector in *DNA Cloning Vol. II a Practical Approach*, D. M. Glover, ed., IRL Pres, Arlington, Virginia pp. 213-238 (1985).

In a particular embodiment, it may be desirable to negatively control receptor binding; particularly, when toxicity to a cell is no longer desired or if it is desired to reduce toxicity to a lower level. In this case, ligand-receptor polypeptide binding assays may be used to screen for compounds that bind to the receptor polypeptides but do not confer toxicity to a cell expressing the receptor. The examples of a molecule that can be used to block ligand binding include an antibody that specifically recognizes the ligand binding domain of the receptor polypeptides such that ligand binding is decreased or prevented as desired.

In another embodiment, receptor polynucleotide or polypeptide expression could be altered, for example, reduction by mediating RNA interference (RNAi), including the use of a silencing element directed against specific receptor polynucleotide sequence. Silencing elements can include, but are not limited to, sense suppression elements, antisense suppression elements, double stranded RNA (dsRNA), siRNA, amiRNA, miRNA, or hairpin suppression elements. Inhibition of expression of coding sequences of a receptor polynucleotide or polypeptide by a silencing element may occur by providing exogenous nucleic acid silencing element constructs, for example, a dsRNA, to an insect. Silencing element constructs contain at least one silencing element targeting the receptor polynucleotide.

In particular embodiments, reducing the polynucleotide level and/or the polypeptide level of the target sequence in a pest results in less than 95%, less than 90%, less than 80%, less than 70%, less than 60%, less than 50%, less than 40%, less than 30%, less than 20%, less than 10%, or less than 5% of the polynucleotide level, or the level of the polypeptide encoded thereby, of the same target sequence in an appropriate target insect. Methods to assay for the level of the RNA transcript include, but are not limited to qRT-PCR, Northern blotting, RT-PCR, and digital PCR.

In specific embodiments, the silencing element has 100% sequence identity to the target receptor polynucleotide. In other embodiments, the silencing element has homology to the target polypeptide have at least 50%, 60%, 70%, 80%, 85%, 90%, 91%, 92%, 93%, 94%, 95%, 96%, 97%, 98%, 99%, or greater sequence identity to a region of the target polynucleotide, where the sequence identity to the target polynucleotide need only be sufficient to decrease expression of the target receptor polynucleotide. Generally, sequences of at least 19 nucleotides, 21 nucleotides, 24 nucleotides, 50 nucleotides, 100 nucleotides, 200 nucleotides, or greater may be used.

Fragments and variants of the disclosed nucleotide sequences and polypeptides encoded thereby are contemplated herein. By "fragment" is intended a portion of the nucleotide sequence, or a portion of the amino acid sequence, and hence a portion of the polypeptide encoded thereby. Fragments of a nucleotide sequence may encode polypeptide fragments that retain the biological activity of the native polypeptide and, for example, bind toxins, including Bt toxins. Alternatively, fragments of a nucleotide sequence that are useful as hybridization probes. Thus, fragments of a nucleotide sequence may range from at least about 20 nucleotides, about 50 nucleotides, about 100 nucleotides, and up to the full-length nucleotide sequence encoding the polypeptides of the embodiment.

A fragment of a toxin receptor nucleotide sequence that encodes a biologically active portion of a toxin receptor polypeptide may encode at least 15, 25, 30, 50, 100, 150, 200 or 250 contiguous amino acids, or up to the total number of amino acids present in a full-length toxin receptor polypeptide. Fragments of a toxin receptor nucleotide sequence that are useful as hybridization probes for PCR primers generally need not encode a biologically active portion of a toxin receptor polypeptide.

Thus, a fragment of a toxin receptor nucleotide sequence may encode a biologically active portion of a toxin receptor polypeptide, or it may be a fragment that can be used as a hybridization probe or PCR primer using methods disclosed below. A biologically active portion of a toxin receptor polypeptide can be prepared by isolating a portion of one of the toxin receptor nucleotide sequences, expressing the encoded portion of the toxin receptor polypeptide (e.g., by recombinant expression in vitro), and assessing the activity of the encoded portion of the toxin receptor polypeptide. Nucleic acid molecules that are fragments of a toxin receptor nucleotide sequence comprise at least 16, 20, 50, 75, 100, 150, 200, 250, 300, 350, 400, 450, 500, 550, 600, 650, 700, 800, 900, 1,000, 1,100, 1,200, 1,300, 1,400, 1500, 2000, or 2500 nucleotides, or up to the number of nucleotides present in a full-length toxin receptor nucleotide sequence disclosed herein.

By "variants" is intended substantially similar sequences. For nucleotide sequences, conservative variants include those sequences that, because of the degeneracy of the genetic code, encode the amino acid sequence of one of the toxin receptor polypeptides. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis, but which still encode a toxin receptor protein. Generally, variants of a particular nucleotide sequence of the embodiment will have at least about 40%, 50%, 60%, 65%, 70%, generally at least about 75%, 80%, 85%, 86%, 87%, 88, 89%, 90%, 91%, 92%, 93%, 94%, 95%, 96%, 97%, 98%, or 99% or more sequence identity to that particular nucleotide sequence as determined by sequence alignment programs described elsewhere herein using default parameters.

Variants of a particular nucleotide sequence of the embodiment (i.e., the reference nucleotide sequence) can also be evaluated by comparison of the percent sequence identity between the polypeptide encoded by a variant nucleotide sequence and the polypeptide encoded by the reference nucleotide sequence. Thus, for example, isolated nucleic acids that encode a polypeptide with a given percent sequence identity to the polypeptide as set forth in any one of SEQ ID NOs: 180-314 are disclosed. Percent sequence identity between any two polypeptides can be calculated using sequence alignment programs described elsewhere herein using default parameters. Where any given pair of polynucleotides disclosed herein is evaluated by comparison of the percent sequence identity shared by the two polypeptides they encode, the percent sequence identity between the two encoded polypeptides is at least about 40%, 45%, 50%, 55%, 60%, 65%, 70%, generally at least about 75%, 80%, 85%, 90%, 91%, 92%, 93%, 94%, 95%, 96%, 97%, 98%, 99%, or more sequence identity. In some embodiments, variant polynucleotides are provided encoding chimeric polypeptides comprising an N-terminal Region of a first toxin receptor polypeptide of the disclosure operably fused to a C-terminal Region of a second toxin receptor polypeptide of the disclosure.

Variants of a particular nucleotide sequence disclosed herein (i.e., the reference nucleotide sequence) can also be evaluated by comparison of the percent sequence identity between the polypeptide encoded by a variant nucleotide sequence and the polypeptide encoded by the reference nucleotide sequence. Thus, for example, isolated nucleic acids that encode a polypeptide with a given percent sequence identity to the polypeptide of SEQ ID NOs: 180-314 are disclosed. Percent sequence identity between any two polypeptides can be calculated using sequence alignment programs described elsewhere herein using default parameters. Where any given pair of polynucleotides is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99%, or more sequence identity.

By "variant" protein is intended a protein derived from the native protein by deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Variant polypeptides and polynucleotides in the present embodiment also include homologous and orthologous polypeptide sequences. Variant proteins contemplated herein are biologically active, that is they continue to possess the desired biological activity of the native protein, that is, activity as described herein (for example, Bt toxin binding activity). Such variants may result from, for example, genetic polymorphism or from human manipulation. Biologically active variants of a native toxin receptor protein will have at least about 40%, 50%, 60%, 65%, 70%, generally at least about 75%, 80%, 85%, 86%, 87%, 88%, 89%, such as at least about 90%, 91%, 92%, 93%, 94%, 95%, 96%, 97%, 98%, 99%, or more sequence identity to the amino acid sequence for the native protein as determined by sequence alignment programs described elsewhere herein using default parameters. A biologically active variant of a protein may differ from that protein by as few as 1-15 amino acid residues, as few as 1-10, such as 6-10, as few as 5, as few as 4, 3, 2, or even 1 amino acid residue.

In one embodiment, the variants of a target receptor can be used for high throughput screening, such as, but not limited to, phage display. This screening can be used to develop increased toxicity of an insecticide, or to screen for a novel site of action. The high throughput screen can also be applied to screening insects or insect populations for altered susceptibility to an insecticide. Furthermore, more than one variant, fragment, receptor, or the combination of variants, fragments, or receptors can be used in one large, but multiple screening assay.

The polypeptides of the embodiment may be altered in various ways including amino acid substitutions, deletions, truncations, and insertions. Methods for such manipulations are generally known in the art. For example, amino acid sequence variants of the toxin receptor polypeptides can be prepared by mutations in the DNA. Conservative substitutions, such as exchanging one amino acid with another having similar properties, may be made.

The polypeptide and nucleotide sequences contemplated herein include both the naturally occurring sequences as well as mutant forms. Likewise, the proteins of the embodiment encompass naturally occurring proteins as well as variations and modified or edited forms thereof. Such variants may continue to possess the desired toxin binding activity.

The deletions, insertions, and substitutions of the protein sequences encompassed herein are not expected to produce radical changes in the characteristics of the protein. For example, it is recognized that at least about 10, 20, 50, 100, 150, 200, 250, 300, 350, 400, 450, 500, 550, 600, 650, 700, 750, 800, 850, 900, 950, and up to 960 amino acids may be deleted from the N-terminus of a polypeptide that has the amino acid sequence set forth in SEQ ID NOs: 180-314, and still retain binding function. It is further recognized that at least about 10, 20, 30, 40, 50, 60, 70, 80, 90, 100, 110, and up to 119 amino acids may be deleted from the C-terminus of a polypeptide that has the amino acid sequence set forth in SEQ ID NOs: 180-314, and still retain binding function. Deletion variants encompass polypeptides having these deletions. It is recognized that deletion variants that retain binding function encompass polypeptides having these N-terminal or C-terminal deletions, or having any deletion combination thereof at both the C- and the N-termini. In one embodiment, a deletion, insertion, and/or substitution of the protein sequence may alter or signify an alteration in susceptibility to a toxin. The activity may be evaluated by receptor binding and/or toxicity assays.

Variant nucleotide sequences and polypeptides also encompass sequences and polypeptides derived from a mutagenic and recombinogenic procedure such as DNA shuffling. With such a procedure, one or more different toxin receptor coding sequences can be manipulated to create a new toxin receptor, including but not limited to a new toxin receptor, possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the toxin receptor genes and other known toxin receptor genes to obtain a new gene coding for a polypeptide with an improved property of interest, such as an increased or decreased ligand affinity in the case of a receptor.

Where the receptor polypeptides are expressed in a cell and associated with the cell membrane (for example, by a transmembrane segment), in order for the receptor to bind a desired ligand, for example a Cry2A toxin, the receptor's ligand binding domain must be available to the ligand. In this aspect, it is recognized that the native toxin receptor is oriented such that the toxin binding site is available extracellularly.

Accordingly, in methods comprising use of intact cells, the embodiment provides cell surface toxin receptors. By a "cell surface toxin receptor" is intended a membrane-bound receptor polypeptide comprising at least one extracellular toxin binding site. A cell surface receptor of the embodiment comprises an appropriate combination of signal sequences and transmembrane segments for guiding and retaining the receptor at the cell membrane such that that toxin binding site is available extracellularly. Where native toxin receptors are used for expression, deduction of the composition and configuration of the signal sequences and transmembrane segments, it is not necessary to ensure the appropriate topology of the polypeptide for displaying the toxin binding site extracellularly. As an alternative to native signal and transmembrane sequences, heterologous signal and transmembrane sequences could be utilized to produce a cell surface receptor polypeptide.

It is recognized that it may be of interest to generate toxin receptors that are capable of interacting with the receptor's ligands intracellularly in the cytoplasm, in the nucleus or other organelles, in other subcellular spaces; or in the extracellular space. Accordingly, the embodiment encompasses variants of the receptors, wherein one or more of the segments of the receptor polypeptide is modified to target the polypeptide to a desired intra- or extracellular location.

Also encompassed are receptor fragments and variants that are useful, among other things, as binding antagonists that will compete with a cell surface receptor disclosed herein. Such a fragment or variant can, for example, bind a toxin but not be able to confer toxicity to a particular cell. In this aspect, the embodiment provides secreted toxin receptors, i.e. receptors that are not membrane bound. In another embodiment, receptor fragments and variants are useful, among other things, as binding antagonists that have a synergistic relationship to a toxin. The secreted receptors can contain a heterologous or homologous signal sequence facilitating their secretion from the cell expressing the receptors; and further comprise a secretion variation in the region corresponding to transmembrane segments. By "secretion variation" is intended that amino acids corresponding to a transmembrane segment of a membrane bound receptor comprise one or more deletions, substitutions, insertions, or any combination thereof; such that the region no longer retains the requisite hydrophobicity to serve as a transmembrane segment. Sequence alterations to create a secretion variation can be tested by confirming secretion of the polypeptide comprising the variation from the cell expressing the polypeptide.

The polypeptides of the embodiment can be purified from cells that naturally express them, purified from cells that have been altered to express them (e.g., recombinant host cells) or synthesized using polypeptide synthesis techniques. In one embodiment, the polypeptide is produced by recombinant DNA methods. In such methods a nucleic acid molecule encoding the polypeptide is cloned into an expression vector as described more fully herein and expressed in an appropriate host cell. The polypeptide is then isolated from cells using polypeptide purification techniques. Alternatively, the polypeptide or fragment can be synthesized using peptide synthesis methods.

Heterologous polypeptides in which one or more polypeptides are fused with at least one polypeptide of interest are also contemplated herein. One embodiment encompasses fusion polypeptides in which a heterologous polypeptide of interest has an amino acid sequence that is not substantially homologous to the receptor polypeptide. In this embodiment, the receptor polypeptide and the polypeptide of interest may or may not be operatively linked. An example of operative linkage is fusion in-frame so that a single polypeptide is produced upon translation. Such fusion polypeptides can, for example, facilitate the purification of a recombinant polypeptide.

In another embodiment, the fused polypeptide of interest may contain a heterologous signal sequence at the N-terminus facilitating its secretion from specific host cells. The expression and secretion of the polypeptide can thereby be increased by use of the heterologous signal sequence.

The embodiment is also directed to polypeptides in which one or more domains in the polypeptide described herein are operatively linked to heterologous domains having homologous functions. Thus, the toxin binding domain can be replaced with a toxin binding domain for other toxins. Thereby, the toxin specificity of the receptor is based on a toxin binding domain other than the domain encoded by toxin receptor but other characteristics of the polypeptide, for example, membrane localization and topology is based on the toxin receptor of SEQ ID NO: 180-314.

Alternatively, the native toxin binding domain may be retained while additional heterologous ligand binding domains, including but not limited to heterologous toxin binding domains are comprised by the receptor. Thus, fusion polypeptides in which a polypeptide of interest is a heterologous polypeptide comprising a heterologous toxin binding domains are also contemplated herein. Examples of heterologous polypeptides comprising Cry1 toxin binding domains include, but are not limited to those disclosed in Knight et al (1994) *Mol. Micro.* 11: 429-436; Lee et al. (1996) *Appl. Environ. Micro.* 63: 2845-2849; Gill et al. (1995) *J. Biol. Chem.* 270: 27277-27282; Garczynski et al. (1991) *Appl. Environ. Microbiol.* 10: 2816-2820; Vadlamudi et al. (1995) *J. Biol. Chem.* 270(10):5490-4, and U.S. Pat. No. 5,693,491.

Polypeptide variants contemplated herein include those containing mutations that either enhance or decrease one or more domain functions. For example, in the toxin binding domain, a mutation may be introduced that increases or decreases the sensitivity of the domain to a specific toxin.

As an alternative to the introduction of mutations, an increase in activity may be achieved by increasing the copy number of ligand binding domains. Thus, the embodiment also encompasses receptor polypeptides in which the toxin binding domain is provided in more than one copy.

The embodiment further encompasses cells containing receptor expression vectors comprising the toxin receptor sequences, and fragments and variants thereof. The expression vector can contain one or more expression cassettes used to transform a cell of interest. Transcription of these genes can be placed under the control of a constitutive or inducible promoter (for example, tissue- or cell cycle-preferred).

Where more than one expression cassette is utilized, the cassette that is additional to the cassette comprising at least one receptor sequence may comprise a receptor sequence disclosed herein or any other desired sequence.

The nucleotide sequences disclosed herein can be used to isolate homologous sequences in insect species other than *Helicoverpa zea*, *Chrysodeixis includens*, *Spodoptera frugiperda*, or *Ostrinia nubilalis*, particularly other lepidopteran species, more particularly other Noctuidae or Crambidae species.

"Percent (%) sequence identity" with respect to a reference sequence (subject) is determined as the percentage of amino acid residues or nucleotides in a candidate sequence (query) that are identical with the respective amino acid residues or nucleotides in the reference sequence, after aligning the sequences and introducing gaps, if necessary, to achieve the maximum percent sequence identity, and not considering any amino acid conservative substitutions as part of the sequence identity. Alignment for purposes of determining percent sequence identity can be achieved in various ways that are within the skill in the art, for instance, using publicly available computer software such as BLAST, BLAST-2. Those skilled in the art can determine appropriate parameters for aligning sequences, including any algorithms needed to achieve maximal alignment over the full length of the sequences being compared. The percent identity between the two sequences is a function of the number of identical positions shared by the sequences (e.g., percent identity of query sequence=number of identical positions between query and subject sequences/total number of positions of query sequence×100).

The nucleotide sequences disclosed herein may be used to isolate corresponding sequences from other organisms, particularly other insects, more particularly other Lepidopteran or Coleopteran species. In this manner, methods such as PCR, hybridization, and the like can be used to identify such sequences based on their sequence homology to the sequences set forth herein. Additionally, a transcriptome can be used to identify such sequences based on their sequence homology to the sequences set forth herein. See Yinu et al (2012). *Plos One*, 7(8): e43713. Sequences isolated based on their sequence identity to the entire toxin receptor sequences set forth herein or to fragments thereof are contemplated herein. Such sequences include sequences that are orthologs of the disclosed sequences. By "orthologs" is intended genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species. Thus, isolated sequences which encode polypeptides having toxin receptor activity and which hybridize under stringent conditions to the *H. zea* toxin receptor sequences disclosed herein, or to fragments thereof, are contemplated herein.

In a PCR-based approach, oligonucleotide primers can be designed for use in PCR reactions to amplify corresponding DNA sequences from cDNA or genomic DNA extracted from any organism of interest. Methods of PCR include, but are not limited to, methods using paired primers, nested primers, single specific primers, degenerate primers, gene-specific primers, vector-specific primers, partially-mismatched primers, and the like.

Degenerate bases, otherwise known as wobbles, are equimolar mixtures of two or more different bases at a given position within a sequence. Since the genetic code is degenerate (e.g., histidine could be encoded by CAC or CAT), an oligo probe may be prepared with wobbles at the degenerate sites (e.g., for histidine CAY is used where Y=C+T). There are eleven standard wobbles mixtures. The standard code letters for specifying a wobble are as follows: R=A+G; Y=C+T; M=A+C; K=G+T; S=C+G; W=A+T; B=C+G+T; D=A+G+T; H=A+C+T; V=A+C+G; and N=A+C+G+T.

Degenerate bases are used to produce degenerate probes and primers. Degenerate bases are often incorporated into oligonucleotide probes or primers designed to hybridize to an unknown gene that encodes a known amino acid sequence. They may also be used in probes or primers that are designed based upon regions of homology between similar genes in order to identify a previously unknown ortholog. Oligonucleotides with wobbles are also useful in random mutagenesis and combinatorial chemistry.

In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}$P, or any other detectable marker. Thus, for example, probes for hybridization can be made by labeling synthetic oligonucleotides based on the toxin receptor sequences. Methods for preparation of probes for hybridization and for construction of cDNA and genomic libraries are generally known in the art and are disclosed in Sambrook et al. (1989) *Molecular Cloning: A Laboratory Manual* (2d ed., Cold Spring Harbor Laboratory Press, Plainview, New York).

For example, an entire toxin receptor sequences disclosed herein, or one or more portions thereof, may be used as a probe capable of specifically hybridizing to corresponding toxin receptor sequences and messenger RNAs. To achieve specific hybridization under a variety of conditions, such probes include sequences that are unique among toxin receptor sequences and are at least about 10 nucleotides in length, or at least about 20 nucleotides in length. Such probes may be used to amplify corresponding toxin receptor sequences from a chosen plant organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook et al. (1989) *Molecular Cloning: A Laboratory Manual* (2d ed., Cold Spring Harbor Laboratory Press, Plainview, New York).

Hybridization of such sequences may be carried out under stringent conditions. By "stringent conditions" or "stringent hybridization conditions" is intended conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, such as less than 500 nucleotides in length.

Typically, stringent conditions will be those in which the salt concentration is less than about 1.5 M Na+ ion, typically about 0.01 to 1.0 M Na+ ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the $T_m$ can be approximated from the equation of Meinkoth and Wahl (1984) *Anal. Biochem.* 138:267-284: $T_m = 81.5°$ C. $+ 16.6$ (log M) $+ 0.41$ (% GC) $- 0.61$ (% form) $- 500/L$; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization, and/or wash conditions can be adjusted to hybridize to sequences of the desired identity. For example, if sequences with ≥90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution), it is preferred to increase the SSC concentration so that a higher temperature can be used. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, New York); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed., Cold Spring Harbor Laboratory Press, Plainview, New York).

Thus, isolated sequences that encode for a toxin receptor protein and which hybridize under stringent conditions to the toxin receptor sequences disclosed herein, or to fragments thereof, are encompassed herein.

The compositions and screening methods of the embodiment are useful for identifying cells expressing the toxin receptors, variants and homologues thereof. Such identification could utilize detection methods at the protein level, such as ligand-receptor binding, or at the nucleotide level. Detection of the polypeptide could be in situ by means of in situ hybridization of tissue sections but may also be analyzed by bulk polypeptide purification and subsequent analysis by Western blot or immunological assay of a bulk preparation. Alternatively, receptor gene expression can be detected at the nucleic acid level by techniques known to those of ordinary skill in any art using complimentary polynucleotides to assess the levels of genomic DNA, mRNA, and the like. As an example, PCR primers complimentary to the nucleic acid of interest can be used to identify the level of expression. Tissues and cells identified as expressing the receptor sequences of the embodiment are determined to be susceptible to toxins that bind the receptor polypeptides.

Where the source of the cells identified to express the receptor polypeptides is an organism, for example an insect plant pest, the organism is determined to be susceptible to toxins capable of binding the polypeptides. In a particular embodiment, identification is in a Lepidopteran or Coleopteran plant pest expressing a toxin receptor set forth herein.

The embodiment encompasses antibody preparations with specificity against the receptor polypeptides, modified or edited receptor polypeptides, or variants or fragments thereof. In further embodiments, the antibodies are used to detect receptor expression in a cell.

In one aspect, the embodiment is drawn to compositions and methods for modulating susceptibility of plant pests to Bt or non-Bt toxins. However, it is recognized that the methods and compositions may be used for modulating susceptibility of any cell or organism to the toxins. By "modulating" is intended that the susceptibility of a cell or organism to the cytotoxic effects of the toxin is increased or decreased. By "susceptibility" is intended that the viability of a cell contacted with the toxin is decreased. Thus the embodiment encompasses expressing the cell surface receptor polypeptides to increase or decrease susceptibility of a target cell or organ to toxins. Such increases in toxin susceptibility are useful for medical and veterinary purposes in which eradication or reduction of viability of a group of cells is desired. Such increases in susceptibility are also useful for agricultural applications in which eradication or reduction of populations of particular plant pests is desired.

Plant pests of interest include, but are not limited to insects, nematodes, and the like. Nematodes include parasitic nematodes such as root-knot, cyst, and lesion nematodes, including *Heterodera* spp., *Meloidogyne* spp., and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include *Pratylenchus* spp.

In one embodiment, the methods comprise creating a genetically edited or modified insect, or colony thereof. The polynucleotide sequence of the target receptor may be used to knockout or mutate the target receptor polynucleotide in an insect by means known to those skilled in the art, including, but not limited to use of a Cas9/CRISPR system, TALENs, homologous recombination, and viral transformation. See Ma et al (2014), *Scientific Reports,* 4: 4489; Daimon et al (2013), *Development, Growth, and Differentiation,* 56(1): 14-25; and Eggleston et al (2001) *BMC Genetics,* 2:11.

A knockout or mutation of the target receptor polynucleotide should presumably result in an insect having reduced or altered susceptibility to an insecticidal toxin or other pesticide. In some embodiments, the edit or modification targets the coding region of the gene. In another embodiment, the edit or modification targets a regulatory element, for example, a promoter region. The resulting resistant insect, or colony thereof, can be used to screen potential new active toxins or other agents for new or different sites of action. Current or novel insecticidal toxins can also be characterized using a resistant insect line, for example for assessing mode of action or site of action of the current or novel insecticidal toxin.

In one embodiment, one or more native polynucleotides as set forth in SEQ ID NOs: 45-179, or an expression construct comprising a sequence as set forth in SEQ ID NOs: 45-179, and compositions comprising said sequences, may be edited in an insect or insect cell or inserted by genome editing using double stranded break inducing agent, such as a CRISPR/Cas9 system. In one embodiment, the genomic DNA sequence set forth in SEQ ID NOs: 1 or 2 may be edited or inserted by genome editing using double stranded break inducing agent, such as a CRISPR/Cas9 system. As used herein, the term "edited" or "genetically edited," means using a double stranded or single stranded break inducing agent, such as a Cas9/CRISPR system, to induce a change in the native sequence.

CRISPR loci (Clustered Regularly Interspaced Short Palindromic Repeats) (also known as SPIDRs—SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (See WO2007/025097).

Cas endonuclease relates to a Cas protein encoded by a Cas gene, wherein said Cas protein is capable of introducing a double strand break into a DNA target sequence. The Cas endonuclease is guided by a guide polynucleotide to recognize and optionally introduce a double strand break at a specific target site into the genome of a cell (See U.S. 2015/0082478). The guide polynucleotide/Cas endonuclease system includes a complex of a Cas endonuclease and a guide polynucleotide that is capable of introducing a double strand break into a DNA target sequence. The Cas endonuclease unwinds the DNA duplex in close proximity of the genomic target site and cleaves both DNA strands upon recognition of a target sequence by a guide RNA if a correct protospacer-adjacent motif (PAM) is approximately oriented at the 3' end of the target sequence.

In one embodiment, the methods comprise creating an insect cell, an insect, or a colony thereof, wherein the target gene is edited so that it is no longer functional. The polynucleotide sequence of the target gene can be used to knockout the target gene polynucleotide in an insect by means known to those skilled in the art, including, but not limited to use of a Cas9/CRISPR system, TALENs, homologous recombination, and viral transformation. See Ma et al (2014), *Scientific Reports,* 4: 4489; Daimon et al (2013), *Development, Growth, and Differentiation,* 56(1): 14-25; and Eggleston et al (2001) *BMC Genetics,* 2:11.

In one embodiment, the methods relate to methods that result in rescue of resistance achieved through the target receptor polynucleotide expression (e.g., targeting a negative regulatory element by RNAi) or a reverse mutation.

In one embodiment, the methods relate to creating an insect colony resistant to at least one insecticidal toxin. A colony can be made through genetical modification or editing methods. Alternatively, receptor polynucleotides may be used to screen for mutants, insects lacking the target receptor polynucleotide, or any other genetic variants. Subsequent screening and selection on an insecticidal toxin should result in a resistant colony that may be used as described herein. The methods include, but are not limited to, feeding the insects leaf material from maize plants expressing insecticides or purified insecticides applied to an artificial diet, and selecting individuals that survived exposure. The methods may further involve transferring the surviving insects to a standard diet that lacks insecticide to allow the survivors to complete development. The methods may further involve allowing the surviving insects to mate to maintain the colony with selection periodically applied in subsequent generations by feeding the insects leaf material from maize plants expressing insecticides or purified insecticides and selecting surviving insects, and therefore fixing resistance by eliminating individuals that do not carry homozygous resistance alleles.

Methods and compositions disclosed herein relate to genetically edited insect cells, insects, or insect colonies, wherein the genetically edited insect cell, insect, or insect colony is resistant to an insecticidal toxin. In some embodiments, the insect cell, insect, or insect cell colony is susceptible to the insecticidal toxin prior to any genetic editing. In some embodiments, a native insecticidal toxin receptor is genetically edited. In certain embodiments, the native insecticidal receptor comprises as sequence as set forth in any one of SEQ ID NOs: 180-314.

One embodiment encompasses a method of screening insect populations for altered levels of susceptibility to an insecticide, including a resistance monitoring assay. An assay for screening altered levels of susceptibility includes, but is not limited to, assaying a target receptor gene DNA sequence, RNA transcript, polypeptide, or activity of the target receptor polypeptide. Methods for assaying include, but are not limited to DNA sequencing, Southern blotting, northern blotting, RNA sequencing, PCR, RT-PCR, qPCR, qRT-PCR, protein sequencing, western blotting, mass spectrometry identification, antibody preparation and detection, and enzymatic assays. A change in sequence in a DNA, RNA transcript, or polypeptide can indicate a resistant insect. Also, a change in the amount or abundance of an RNA, a polypeptide, or an enzymatic activity of a target receptor polypeptide can indicate a resistant insect. In one embodiment, the method includes screening an insect under selection to increase efficiency of selection for a receptor-mediated resistance. In another embodiment, the method comprises screening for a mutation or altered sequence in a disclosed polypeptide receptor of SEQ ID NOs: 180-314, a change in expression of SEQ ID NOs: 180-314, or a change in expression of SEQ ID NOs: 45-179, or a complement thereof, wherein the change indicates receptor-mediated resistance to a toxin. In another embodiment, the method relates to screening an insect for a receptor gene or gene product, transcript, or polypeptide sequence that is different from a native non-resistant insect sequence. In one embodiment, an insect with an altered or mutated sequence is further exposed to an insecticidal toxin, wherein the insecticidal toxin has the same site of action as a Bt toxin. The use of screening for a receptor allows for efficient receptor-mediated resistance selection to create a resistant insect colony.

In one embodiment, the method relates to a method for monitoring insect resistance or altered levels of susceptibility to an insecticidal toxin in a field comprising assaying for altered levels of susceptibility or insect resistance, which may include, but not limited to, assaying a target receptor gene DNA sequence, RNA transcript, polypeptide, or activity of the target receptor polypeptide. Methods for assaying include, but are not limited to DNA sequencing, Southern blotting, northern blotting, RNA sequencing, PCR, RT-PCR, qPCR, qRT-PCR, protein sequencing, western blotting, mass spectrometry identification, antibody preparation and detection, or enzymatic assays. A change in sequence in the DNA, RNA transcript, or polypeptide can indicate a resistant insect. Also, a change in the amount or abundance of an RNA, a polypeptide, or an enzymatic activity of a target receptor polypeptide can indicate a resistant insect. In another embodiment, the method comprises screening for a mutation or altered sequence in a disclosed polypeptide receptor of SEQ ID NOs: 180-314, a change in expression of SEQ ID NOs: 180-314, or a change in expression of SEQ ID NOs: 45-179, or a complement thereof, wherein the change indicates receptor-mediated resistance to a toxin. In a further embodiment, the method relates to applying an insecticidal agent to an area surrounding the environment of an insect or an insect population having an receptor gene or gene product sequence that is different from a native sequence, wherein the insecticidal agent has a different mode of action compared to an insecticidal toxin. In further embodiment, the method comprises implementing an insect management resistance (IRM) plan. In one embodiment, an IRM plan may include, but not limited to, adding refuge or additional refuge, rotation of crops, planting additional natural refuge, and applying an insecticide with a different site of action.

In one embodiment, the methods comprise an assay kit to monitor resistance. The simple kits can be used in the field or in a lab to screen for the presence of resistant insects. In preferred embodiments, an antibody raised against SEQ ID NOs: 180-314 may be used to determine levels of, or the presence of, absence of or change in concentration of SEQ ID NOs: 180-314 in an insect population. In another embodiment, an assessment of SEQ ID NOs: 45-179 is performed, either to assess sequence changes in an insect or insect population target receptor sequence or for expression changes relative to a control or for sequence variation. Molecular techniques to accomplish the resistance monitoring in a kit, such as but not limited to PCR, RT-PCR, qRT-PCR, Southern blotting, Northern blotting, and others.

The following examples are offered by way of illustration and not by way of limitation.

EXPERIMENTAL

Example 1: Specific Binding of Bt Toxin to Lepidopteran Insects

Midguts from fourth instar *Helicoverpa zea, Ostrinia nubilalis, Spodoptera frugiperda*, and *Chrysodeixis includens* larvae were isolated for brush border membrane vesicle (BBMV) preparation using the protocol by Wolfersberger et al. (1987) *Comp. Biochem. Physiol.* 86A:301-308. An in-solution competitive binding assay was performed using 40 µg (protein content) of BBMVs from *H. zea* (corn earworm) and *O. nubilalis* and 10 nM IP2.127 labeled with Alexa-488 fluorescence molecule to measure specific binding of IP2.127 to *H. zea* or *O. nubilalis*. An in-solution competitive binding assay was performed using 20 µg (protein content) of BBMVs from *S. frugiperda* (fall armyworm) and 10 nM IP2.127 labeled with Alexa-488 fluorescence molecule to measure specific binding of IP2.127 to *S. frugiperda*. Binding buffer used for IP2.127 binding was a sodium carbonate buffer consisting of 50 mM sodium carbonate/HCl pH 9.6, 150 mM NaCl, 0.1% Tween 20. An in-solution binding competitive binding assay was performed using 40 µg (protein content) of BBMVs from *C. includens* (soybean looper) and 5 nM IP2.127 labeled with Alexa-488 fluorescence molecule to measure specific binding of IP2.127 to *C. includens*. Binding buffer used for IP2.127 binding in *C. includens* was a CAPS buffer consisting of 20 mM CAPS pH 10.5, 150 mM NaCl, and 0.1% Tween 20.

Example 2: Isolation of Lepidopteran Bt Toxin Receptor

A solution binding assay was done using *H. zea* BBMVs with biotin labeled IP2.127. The binding assay was followed by the detergent (Triton X100®) extraction of proteins from BBMVs bound to the biotin-labeled IP2.127. The proteins bound to biotin labeled IP2.127 were then "co-precipitated" (co-isolated) using Dynabeads® MyOne™ Streptavidin T1 (Life Technologies #65601) which binds the biotin-labeled IP2.127 and proteins bound to biotin labeled IP2.127 while unbound proteins are washed away. The samples are then separated by SDS-PAGE and stained to visualize protein bands.

Solution binding assays were done using one of each of *O. nubilalis, S. frugiperda*, or *C. includens* BBMVs with IP2.127. The binding assays were followed by the detergent (Triton X100®) extraction of proteins from BBMVs bound to the IP2.127. The proteins bound to IP2.127 were then "co-immunoprecipitated" (co-isolated) using Dynabeads® Protein G (Life Technologies #10007D), which were bound to IP2.127 antibody. The beads bound to antibody then bind the IP2.127 and proteins bound to IP2.127 and unbound proteins are washed away. The samples are then separated by SDS-PAGE and stained to visualize protein bands The unique band was excised from the SDS-PAGE gel, digested by trypsin, and the resulting peptides analyzed by mass spectrometry for identification. The resulting peptide sequences from the protein band were identified for *H. zea* with 13% peptide sequence coverage, for *O. nubilalis* with 9% peptide sequence coverage, for *S. frugiperda* with 21% peptide sequence coverage, and for *C. includens* with 9% peptide sequence coverage. Open reading frames (ORFs) were identified in Vector NTI® Suite software (available from Informax, Inc., Bethesda, MD) to determine a nucleotide sequence for *H. zea*, for *O. nubilalis*, for *S. frugiperda*, and for *C. includens*. The cDNA sequences encoding the identified region were blasted to a proprietary *H. zea, O. nubilalis, S. frugiperda* and *C. includens* transcriptome. Table 1 indicates cDNA sequences identified and homologous sequences from other corn pests. Further sequence analysis was conducted to verify the cDNA sequence and to isolate variants by isolating cDNA from *Helicoverpa zea, Ostrinia nubilalis*, and *Chrysodeixis includens* and cloning the receptor sequences using species specific primers matching to the transcriptome sequences into *E. coli* (for methods see Maniatis, T., E. F. Fritsch, and J. Sambrook. Molecular Cloning, a Laboratory Manual, 1982).

TABLE 1

The receptor nucleotide coding sequence for *H. zea* was identified by mass spectrometry. This sequence was then blasted against proprietary sequence databases and the remaining sequences were identified with >50% homology.

| Gene ID | Species | % homology |
| --- | --- | --- |
| ATP-binding cassette sub-family A member 3 XnoC3 | *Helicoverpa zea* | 100 |
| ATP-binding cassette sub-family A member 3 5NOC3 | *Ostrinia nubilalis* | 66.1 |
| ATP-binding cassette sub-family A member 3 XnoC3 | *Spodoptera frugiperda* | 74.5 |
| Atp-binding cassette sub-family G member/ARP2_G246 XnoC3 | *Ostrinia nubilalis* | 66.1 |

Example 3: Single Guide RNA (sgRNA) Design, Preparation and Selection

FAW ABCA3 genomic sequence was identified in the FAW Pioneer PacBio Assembly (v1) genome model (SEQ ID NO: 2). CRISPRscan (TARScanV1) bioinformatics tool was used to identify guide RNA sequences to target the SfABCA3 gene using the FAW Pioneer PacBio Assembly (v1) as the selected genome, gene set as query type and PAM set as NGG. Resulting guide sequences with a target length of 20 nucleotides were identified from the CRISPRscan results, which also looks for any offsite target or seed sequence hits in reference genome (target DNA sequence set forth in SEQ ID NOs: 315-334, See Table 2). Guide sequences were further selected based upon position across the gene, with preference given to sequences that started with GG or G. Twenty guide sequences were prepared and screened for in vitro cleavage following directions in Guide-it sgRNA Screening kit (Clontech), using synthesized gBlock DNA fragments between 801 bp and 1750 bp (IDT) as template, matching desired region in FAW genome reference sequences (SEQ ID NO: 1). The guide RNAs were prioritized based upon their ability to cleave the full-length DNA template and location of guide target site. sgRNA design and preparation was performed essentially as described in Wang et al. 2016. *Insect Biochemistry and Molecular Biology*, 76, 11-17.

TABLE 2

Small guide RNAs ("sgRNA" or "gRNA") target region selected for microinjection into FAW

| SEQ ID NO. | sgRNA Name |
| --- | --- |
| 315 | SfABCA3_guideRNA1 |
| 316 | SfABCA3_guideRNA2 |
| 317 | SfABCA3_guideRNA3 |
| 318 | SfABCA3_guideRNA4 |
| 319 | SfABCA3_guideRNA5 |
| 320 | SfABCA3_guideRNA6 |
| 321 | SfABCA3_guideRNA7 |
| 322 | SfABCA3_guideRNA8 |
| 323 | SfABCA3_guideRNA9 |
| 324 | SfABCA3_guideRNA10 |
| 325 | SfABCA3_guideRNA11 |
| 326 | SfABCA3_guideRNA12 |
| 327 | SfABCA3_guideRNA13 |
| 328 | SfABCA3_guideRNA14 |
| 329 | SfABCA3_guideRNA15 |
| 330 | SfABCA3_guideRNA16 |
| 331 | SfABCA3_guideRNA17 |
| 332 | SfABCA3_guideRNA18 |
| 333 | SfABCA3_guideRNA19 |
| 334 | SfABCA3_guideRNA20 | sgRNAs were prioritized based on position within the gene, with guides initially selected to target the 5'-end, middle of the gene, and 3'-end of the gene. The position on the predicted protein model was then used to help prioritize which guide RNA regions would have NGS targeted amplicon sequencing assays developed for the native sequence of the population and to identify any sequence variation from the genomic model that may interfere with CRISPR-mediated genome editing. sgRNA1, sgRNA12 and sgRNA19 targeted amplicon assays were screened against individual WT FAW DNA samples. The sequence information around sgRNA12 showed diversity, which could result in lower editing efficiency. Due to more highly conserved target sequences for sgRNA1 and sgRNA19, each was prioritized for injections. Sequencing results showed that gRNA1 and gRNA19 produced edits that were heritable.

Example 4. Cas9 mRNA and Protein Egg Microinjection

Freshly laid egg masses were collected and attached to slides with double-sided tape. Using a pulled glass capillary needle and a Nanoject II microinjector (Drummond Scientific), individual eggs were injected with a mixture of sgRNA and cas9 mRNA, or sgRNA and Cas9 protein. GeneART CRISPR nuclease mRNA (#A29387) and GeneART Platinum Cas9 nuclease (#B25641) were from Thermo Fisher Scientific. Completion of microinjections occurred within 2-3 hours of egg collection. The injected eggs were incubated at an appropriate temperature and humidity for hatch and pupation. Cas9 RNA or Cas9 protein injection into FAW eggs was performed essentially as described in Wang et al. 2016. *Insect Biochemistry and Molecular Biology*, 76, 11-17.

Example 5. Identification of SfABCA3 Edits & Family Selection

Genomic DNA was isolated from F0 moth tissue collected after oviposition. The DNA served as the template for targeted amplicon sequencing of PCR products around the injected sgRNA target site. Purified amplicon pools were sequenced via Illumina recommendations on a MiSeq sequencers, generating sequencing reads that were deconvoluted into sample bins by index sequence. Per sample reads were analyzed by identifying reads that belong to a specific amplicon assay via the 5' and 3' targeting primers. Reads were aligned via Bowtie version 2 to the wildtype reference that was used to design the original assays. Differences between the reference sequences were identified by mismatches in alignment and reported via SAM Tools. Sequence edits resulting in mutations of SfABCA3 and early protein termination were identified and the mated single-pairs with at least an edited parent were reared to allow F1 generation to sib-mate (siblings mated amongst themselves).

TABLE 3

| Heritable edits in FAW ABCA3 gRNA1 and gRNA19 current families/colonies | | |
|---|---|---|
| SEQ ID NO: | Target* | Sequence |
| 2 | WT | TGATGTGGAAGAACTTCCTGCAGCAATGGAGGC |
| 21, 43 | gR1 | TGATGTGGAAGAACTTCCTGCAGCA-TGGAGGC |
| 44 | gR1 | TGATGTGGAAGAACTTCCT----CAATGGAGGC |
| 2 | WT | TGTGTC**GCCTAA--C-------CTTCAGTGCACCA**TGGAAAC |
| 5, 40 | gR19 | TGTG--G---AAAGCTTATGTTCTT-A-TG---CATGGAAAC |

*WT means the native genomic sequence; gR1 shows the edits created by sgRNA targeted for sgRNA1 (SEQ ID NO: 315, underlined sequence in WT); gR19 shows the edits created by sgRNA targeted for sgRNA19 (SEQ ID NO: 333, underlined sequence in WT).

F2 larvae were exposed to an ~LC95 dose of IP2.127 in diet bioassay (See Table 4). The larvae that survived to 2$^{nd}$ instar by day 4 were reared out to pupation on plain diet, at which point they were combined, emerged and the moths were sib-mated. The following generations were reared on appropriate plain diet and sib-mated to continue the families. For sgRNA19 family A10-A1 (FAW-2Ag19 family), there was some inbreeding suppression that may have been occurring as colony fitness was decreasing. Backcrosses were done with non-edited FAW and selection of high dose IP2.127 were done at F2 and F3 (see Table 5). Bioassay was done on the Backcrossed F4 of FAW-2Ag19 (against IP2.127) to see resistance ratios (See Table 6).

TABLE 5

| gRNA1 and sgRNA19 gene edited FAW resistant phenotype to IP2.127 | | |
|---|---|---|
| | F3 Results % Survival IP2.127 (300 ppm) | F5 Results % Survival IP2.127 (300 ppm) |
| Wild Type | 5.2 | 1.5 |
| gRNA1 | 90.8 | Not Determined |
| gRNA19 | Not Determined | 92.9 |

TABLE 6

| Resistance of FAW to IP2.127 in the ABCA3 edited lines after selections on larvae of F2 families | | | | | | | |
|---|---|---|---|---|---|---|---|
| | | Selection on F2 larvae | | Assays on F4 (2Ag1) or F5 (2Ag19) larvae | | | |
| FAW | FAW family ID | % Survival to 2nd instar (3 d) | | % Response ** (4 d) | | IC25 (95% CI), | RR based |
| ABCA3 | or colony | Control | IP2.127* | Control | IP2.127* | ppm | on IC25 |
| gRNA19 | Control (SS) | 100 | 1.17 | 3.1 | 97.5 | 4.09 (2.41-5.88) | 1 |
| families | 2Ag19 | 95.0 | 11.2 | 6.3 | 13.8 | >300 | >73 |
| gRNA1 | Control (SS) | 91.7 | 0 | 0 | 100 | 4.29 (2.65-6.15) | 1 |
| families | 2Ag1 | 91.7 | 12.8 | 0 | 1.0 | >300 | >70 |

*IP2.127 at 300 ppm in diet incorporation assays.
** The dead larvae and live first instars are pooled as total response for IC25 and resistance ratio (RR) calculations.

TABLE 4

| Selection of F2 larvae with discriminating IP2.127 dose | | | |
|---|---|---|---|
| | | % Survival | |
| | | IP2.127 (300 ppm) | Control |
| gRNA1 | Wild Type | 0 | 91.7 |
| | Edited | 12.8 | 91.7 |
| gRNA19 | Wild Type | 1.17 | 100 |
| | Edited | 11.2 | 95 |

Example 6: Isolation of Lepidopteran Bt Toxin Receptor

*S. frugiperda* (fall armyworm) 4$^{th}$ instar midguts were dissected, gently dissociated, and fractionated by Ficoll-Pacque gradient. The FAW Ficoll middle cell layer that contained midgut cells and microvilli was collected and then sorted by FACS to isolate microvilli. A ligand blot (far western blot) was performed using these FAW midgut microvilli following protein separation by SDS-PAGE, transfer to nitrocellulose membranes, and probing with Alexa-488-labeled Cry1B.25 as ligand. Bands from sister SDS-PAGE gels that corresponded to those interacting with the ligand on membranes were excised from the gels, digested by trypsin, and the resulting peptides analyzed by tandem liquid chromatography/mass spectrometry for identification. The peptide sequences from a protein band of greater than 191 kDa were identified as corresponding to the coding sequence for a gene annotated as *S. frugiperda* ATP-binding cassette, sub-family B member 1 (ABCB1) with 8 peptide sequences hitting.

HEK293 cell lines were generated expressing a synthetic gene encoding the SfABCB1 protein. Cytotoxicity assays were performed on SfABCB1 expressing HEK cells using various insecticidal proteins including Cry1B.31, Cry1B.25, and Cry1Bj (aka MP258). Cell toxicity was only observed with exposure to Cry1B.31, Cry1B.25, or Cry1Bj. Cell toxicity increased with increasing concentrations of Cry1B.31; cell viability was reduced to less than 40% with 50 nM Cry1B.31.

Example 7: Single Guide RNA (sgRNA) Design, Preparation and Selection

FAW ABCB1 genomic sequences were identified in the FAW Pioneer PacBio Assembly (v1) genome model (SEQ ID NOs: 337, 343). CRISPRscan (TARScanV1) bioinformatics tool was used to identify guide RNA sequences to target the SfABCB1 genes using the FAW Pioneer PacBio Assembly (v1) as the selected genome, gene set as query type and PAM set as NGG. Resulting guide sequences with a target length of 18-20 nucleotides were identified from the CRISPRscan results, which also looks for any offsite target or seed sequence hits in reference genome (target DNA sequence set forth in SEQ ID NOs: 363-369). Guide sequences were further selected based upon position across the gene, with preference given to sequences that started with GG or G. Seven guide sequences were prepared and screened for in vitro cleavage following directions in Guide-it sgRNA Screening kit (Clontech), using PCR amplicons produced from genomic DNA. Four PCR amplicons were designed to capture the 7 gRNA regions. Amplicons were generated from the combined DNA of 29 FAW larvae (primer sequences set forth in SEQ ID NOs: 370-377). The PCR amplicons generated were different sizes than expected based upon FAW genome reference sequences (genome reference SEQ ID NOs: 337, 343).

To determine what changes may be present in regions around the designed gRNA sequences, phosphorylated amplicons were prepared for Pacific Bioscience amplicon sequencing as per vendor recommendations via the Pacific Biosciences barcoded adapter kit. Briefly, sample specific barcode and Pacific Biosciences SRMT bell adapters required for sequencing are ligated to the phosphorylated amplicons and pooled for quantitation. Resulting indexed amplicons pools are bound to the sequencing polymerase via the Pacific Biosciences Binding kit 3.0 and polymerase-amplicon complexes are loaded on the Pacific Biosciences Sequel I. Amplicons are sequenced via manufactures specifications with Sequel Sequencing kit 3.0 and a six hour movie time. Circular consensus sequences are deconvoluted by index via Pacific Biosciences SMRT Link tools and individual molecules are characterized to determine allelic diversity.

Each PCR reaction produced at least 2 amplicons that ranged in size from 1273 bp to 2859 bp, capturing the sequence diversity in sample population (SEQ ID NOs: 345-353). The guide RNAs were prioritized based upon their ability to cleave the PCR amplicon DNA template. sgRNA design and preparation was performed essentially as described in Wang et al. 2016. *Insect Biochemistry and Molecular Biology,* 76, 11-17.

TABLE 7

PCR amplicons of SfABCB1 genomic DNA sequenced by PacBio CCS compared to the expected amplicon sizes from genomic model sequences

| Sample | Genotype | Site | Size | Expected Size |
|---|---|---|---|---|
| Al4970001 | LBC | gRNA1 | 1943 bp | 1930 bp |
| | | | 1964 bp | 1933 bp |
| Al4970002 | LBC | gRNA2-4 | 2326 bp | 2915 bp |
| | | | 2528 bp | 3965 bp |
| Al4970003 | LBC | gRNA5-6 | 2859 bp | 2082 bp |
| | | | 2819 bp | 2018 bp |
| Al4970004 | LBC | gRNA7 | 1310 bp | 1694 bp |
| | | | 1318 bp | 1318 bp |
| | | | 1273 bp | |

TABLE 8

Percent identity table of nucleotide coding sequences for the various SfABCB1 sequences, as aligned in Vector NTI

| | SEQ ID NO. | FAW ABCB1 dpsf0084g043040.427.1 cds ORF 338 | FAW ABCB1 dpsf0084g043040.427.2 exons cds only 339 | FAW ABCB1 like dpsf0244g184860.427.1 342 | SfABCB1 genomic amplicon gRNA1 Al4970001_dpsf0084 exons only 352 |
|---|---|---|---|---|---|
| FAWABCB1 dpsf0084g043040.427.1 cds ORF | 338 | | 100 | 97 | 100 |
| FAWABCB1 dpsf0084g043040.427.2 exons cds only | 339 | | | 97 | 100 |
| FAW ABCB1 like dpsf0244g184860.427.1 | 342 | | | | 98 |
| SfABCB1 genomic amplicon gRNA1 Al4970001_dpsf0084 exons only | 352 | | | | |
| SfABCB1 genomic amplicon gRNA1 Al4970001_dpsf0244 exons only | 353 | | | | |
| SfABCB1 genomic amplicon gRNA2-4 | 354 | | | | |

TABLE 8-continued Percent identity table of nucleotide coding sequences for the various SfABCB1 sequences, as aligned in Vector NTI

| | |
|---|---|
| SfABCB1 genomic amplicon gRNA2-4_Al4970002_dpsf0244_exons only | 355 |
| SfABCB1 genomic amplicon gRNA5-6 Al4970003 amp1 exons only | 356 |
| SfABCB1 genomic amplicon gRNA5-6 Al4970003 amp2 exons only | 357 |
| SfABCB1 genomic amplicon gRNA7 Al4970004 amp1 exons only | 358 |
| SfABCB1 genomic amplicon gRNA7 Al4970004 amp2 exons only | 359 |
| SfABCB1 genomic amplicon gRNA7 Al4970004 amp3 exons only | 360 |

| | SEQ ID NO. | SfABCB1 genomic amplicon gRNA1 Al4970001_dpsf0244 exons only 353 | SfABCB1 genomic amplicon gRNA2-4 Al4970002_dpsf0084_exons only 354 | SfABCB1 genomic amplicon gRNA2-4_Al4970002_dpsf0244_exons only 355 | SfABCB1 genomic amplicon gRNA5-6 Al4970003 amp1 exons only 356 |
|---|---|---|---|---|---|
| FAWABCB1 dpsf0084g043040.427.1 cds ORF | 338 | 97 | 97 | 97 | 98 |
| FAWABCB1 dpsf0084g043040.427.2 exons cds only | 339 | 97 | 97 | 97 | 98 |
| FAW ABCB1 like dpsf0244g184860.427.1 | 342 | 100 | 97 | 98 | 98 |
| SfABCB1 genomic amplicon gRNA1 Al4970001_dpsf0084 exons only | 352 | 98 | 0 | 0 | 0 |
| SfABCB1 genomic amplicon gRNA1 Al4970001_dpsf0244 exons only | 353 | | 0 | 0 | 0 |
| SfABCB1 genomic amplicon gRNA2-4 Al4970002_dpsf0084_exons only | 354 | | | 97 | 0 |
| SfABCB1 genomic amplicon gRNA2-4_Al4970002_dpsf0244_exons only | 355 | | | | 0 |
| SfABCB1 genomic amplicon gRNA5-6 Al4970003 amp1 exons only | 356 | | | | |
| SfABCB1 genomic amplicon gRNA5-6 Al4970003 amp2 exons only | 357 | | | | |
| SfABCB1 genomic amplicon gRNA7 Al4970004 amp1 exons only | 358 | | | | |
| SfABCB1 genomic amplicon gRNA7 Al4970004 amp2 exons only | 359 | | | | |
| SfABCB1 genomic amplicon gRNA7 Al4970004 amp3 exons only | 360 | | | | |

TABLE 8-continued

Percent identity table of nucleotide coding sequences for the various SfABCB1 sequences, as aligned in Vector NTI

| | SEQ ID NO. | SfABCB1 genomic amplicon gRNA5-6 Al4970003 amp2 exons only 357 | SfABCB1 genomic amplicon gRNA7 Al4970004 amp1 exons only 358 | SfABCB1 genomic amplicon gRNA7 Al4970004 amp2 exons only 359 | SfABCB1 genomic amplicon gRNA7 Al4970004 amp3 exons only 360 |
|---|---|---|---|---|---|
| FAWABCB1 dpsf0084g043040.427.1 cds ORF | 338 | 100 | 98 | 100 | 98 |
| FAWABCB1 dpsf0084g043040.427.2 exons cds only | 339 | 100 | 98 | 100 | 98 |
| FAW ABCB1 like dpsf0244g184860.427.1 | 342 | 97 | 98 | 98 | 99 |
| SfABCB1 genomic amplicon gRNA1 Al4970001_dpsf0084 exons only | 352 | 0 | 0 | 0 | 0 |
| SfABCB1 genomic amplicon gRNA1 Al4970001_dpsf0244 exons only | 353 | 0 | 0 | 0 | 0 |
| SfABCB1 genomic amplicon gRNA2-4 Al4970002_dpsf0084_exons only | 354 | 0 | 0 | 0 | 0 |
| SfABCB1 genomic amplicon gRNA2-4_Al4970002_dpsf0244_exons only | 355 | 0 | 0 | 0 | 0 |
| SfABCB1 genomic amplicon gRNA5-6 Al4970003 amp1 exons only | 356 | 98 | 0 | 0 | 0 |
| SfABCB1 genomic amplicon gRNA5-6 Al4970003 amp2 exons only | 357 | | 0 | 0 | 0 |
| SfABCB1 genomic amplicon gRNA7 Al4970004 amp1 exons only | 358 | | | 98 | 97 |
| SfABCB1 genomic amplicon gRNA7 Al4970004 amp2 exons only | 359 | | | | 98 |
| SfABCB1 genomic amplicon gRNA7 Al4970004 amp3 exons only | 360 | | | | | sgRNAs were prioritized based on position within the gene, with guides initially selected to target the 5'-end, middle of the gene, and 3'-end of the gene. The position on the predicted protein model, in combination with the in vitro cleavage assay results, were then used to help prioritize which guide RNA regions would have NGS targeted amplicon sequencing assays developed for the native sequence of the population. Sequence variation between the genome model sequences and the PacBio PCR amplicon sequences were identified and NGS targeted amplicon assays were redesigned based on the PacBio PCR amplicon sequences, then screened against individual WT FAW DNA samples. Based upon the resulting PacBio PCR amplicon sequence information (SEQ ID NOs: 345-348), variations in sequences were observed in NGS primer regions, around sgRNA1 and sgRNA4 which could result in lower PCR assay efficiency and capturing only a portion of SfABCB1 gene sequences. Due to conserved sequences around sgRNA2, it was prioritized for injections, despite have a single base pair mismatch in target sequence of one of the four different genomic sequences for this region (SEQ ID NOs: 337, 343, 347-348, with SEQ ID NO 347 having the single base pair mismatch outside of the seed sequence). Sequencing results showed that sgRNA2 produced an edited sample.

Example 8. Cas9 mRNA and Protein Egg Microinjection

Freshly laid egg masses were collected and attached to slides with double-sided tape. Using a pulled glass capillary needle and a Nanoject II microinjector (Drummond Scientific), individual eggs were injected with a mixture of sgRNA and Cas9 protein. GeneART Platinum Cas9 nuclease (#B25641) was from Thermo Fisher Scientific. Completion of microinjections occurred within 1-3 hours of egg collection. The injected eggs were incubated at an appropriate temperature and humidity for hatch and pupation. Cas9 protein injection into FAW eggs was performed essentially as described in Wang et al. 2016. *Insect Biochemistry and Molecular Biology*, 76, 11-17.

Example 9. Identification of SfABCB1 Edits & Family Selection

Genomic DNA was isolated from F0 moth tissue collected after oviposition. The DNA served as the template for targeted amplicon sequencing of PCR products around the injected sgRNA target site. Purified amplicon pools were sequenced via Illumina recommendations on a MiSeq sequencers, generating sequencing reads that were deconvoluted into sample bins by index sequence. Per sample reads were analyzed by identifying reads that belong to a specific amplicon assay via the 5' and 3' targeting primers. Reads were aligned via Bowtie version 2 to the wildtype reference that was used to design the original assays. Differences between the reference sequences were identified by mismatches in alignment and reported via SAM Tools. Sequence edits resulting in mutation of SfABCB1 and early protein termination were identified and reared to allow F1 generation to sib-mate (siblings mated amongst themselves). Of the 17 injected samples that successfully mated, only one thorax DNA sample showed evidence of genome editing and it was approximately 2% of total NGS reads.

TABLE 9

Edits in FAW ABCB1 gRNA2 F0 family 7-18 (SEQ ID NO: 382)

| SEQ ID NO: | Target* | Sequence |
|---|---|---|
| 335 | WT | TCTCCTTCCCGGTCACCA--TGACCCTTGTAGGCGTTGCTGG |
| 345 | WT | TCTCCTTCCCGGT:ACCA--TGACCCTTGTAGGCGTTGCTGG |
| 341 | WT | TCTCCTTCCCGGTCACCA--TGACCCTTGTAGGCGTTGCTGG |
| 346 | WT | TCTCATTCCCGGTCACCA--TGACCCTTGTAGGCGTTGCTGG |
| 382 | gR2 | TCTCCTTCCCGGT:ACC*CGCTTCCC*GGTGTAGGCGTTGCTGG |
| 384 | gR2-WT | TCTCCTTCCCGGT:ACCA--TGACCCTTGTAGGCGTTGCTGG |

*WT means the native genomic sequence; gR2 shows the edits created by sgRNA targeted for sgRNA2 (SEQ ID NO: 364, underlined sequence in WT, red sequence is the single base mismatch between sgRNA2 and gene sequence).

F2 larvae were exposed to an ~LC95 dose of Cry1B.34 in diet bioassay (See Table 10). The percent survival to 2nd instars (0.57%) were much lower than expected for the SfABCB1 gRNA2 edited 7-18 F2 line on 15 ppm Cry1B.34. Only 1 of the 8 survivors (of 1400 total infested) is similar in size to the control larvae which maybe homozygous resistant genotype. All other 7 survivors are much smaller (at early 2nd instar by day 4), which maybe heterozygous or homozygous susceptible genotypes.

TABLE 10

Selection of F2 larvae with discriminating Cry1B.34 dose

| | | % Survival to $2^{nd}$ instar | |
|---|---|---|---|
| DAT | | Cry1B.34 (15 ppm) | Control |
| 3 d | Wild Type | 0 | 100 |
| | gRNA2 Edited | 0.14% | 100 |
| 4 d | Wild Type | 0.17% | 100 |
| | gRNA2 Edited | 0.57% | 100 |

All publications and patent applications mentioned in the specification are indicative of the level of those skilled in the art to which this disclosure pertains. All publications and patent applications are herein incorporated by reference to the same extent as if each individual publication or patent application was specifically and individually indicated to be incorporated by reference.

Although the foregoing embodiment has been described in some detail by way of illustration and example for purposes of clarity of understanding, certain changes and modifications may be practiced within the scope of the appended claims.

SEQUENCE LISTING (392 sequences)

SEQ ID NO: 1 - DNA, 19306 bp, Spodoptera frugiperda
ttagcagattccttatctgttatgtagatatcgagtatattatatttctctgccagtacaacattgacaagtgaatatgccgtactctattgttaagtgaaaacgttattcgttcaaatataaatcggtctaaaaatataaaaggtaaggtcgtgttcggtacctattcttaaggctctattaattccctaatagtgagtgaagtttgagataaattttctttggtataaaattattactggtcgatgtttgtttatctattttaagaataaaagtctattatggttccgttctattgttttctgtcagtctgatttcttgtcactagttgtcgctagtgaaatgctggttttcatttacatttgtatatttttgtgaaattattattatctcgtacacgatcgagaataaaaattccctggaagcctacggcttacgctgtttcgaagtgcaagctgttgaaaccataagccaaaagttcctaataatgtattaaacaaaatgaaaagtgcaaaatattacaagtgttgaaacatttcgtaagtaataagtcaaactacgtaacaacacctctaatctcctaaatttcatattaagtattgacgcaggtattatcatgttttgataataatgtattatttgacaatactctcaccctactctgttcatgagtaaatggtgcacctcgtcatacagtaaattattaccacagtatacctagtgttatttcgctacttgtctgccttttagggtgtaacggtctcatagggtaggagctaggaataagaaatatatcatggggtaaatggaagtgctgagatagaaagagataagagaaagatcctctattatggtcttgaattaaaaaaatatatttaaaattgatgttagtaatataaaatgtggaaataagccatgtaaacgcaatgtttatttttctagaccaggacataaaacgttatctaattctaatttgctggattaattttatctttcgcattataaaaaaatcacaccaattttcctcgttgttttgataaatgtctttgtaaatatatctccaacagaaattgaggtggattaatgctattgcctaaacactgattgtacttttggtggacgctaaacatggcaagtttcacgtccaagaagtgaaaatgctccctagaaaagcgttgtaatgctgttggtcctacttctttttcctgataaaacacatgattctgactcatgatttataacattaatcgtttatgtaaattgataacactgattagtgtgataaatgattatatttaaattaggtacgtgtaagtgagcgtttatttggcttatgaattgaagtagcactttggctgtccggtagtatcttctgtcgaattttaattaagcgtctgacgcgagtacgaacgaataggagtgttagttattgtatatcatgataggagtgctacacaatgtaactagtaccaacgttatacgagattagctagtggtacctataattatttttacaaataagcaaatctatgaacacttagtcttcagataagataaataggtacatgattgtgtcgtagataagttttcacggatgttctatttgtaattggagtttcccattaattattttttggtaagtgactttcctacttaaattatattattgtaatattaagagccagtgtagaaagggggtatttggttcgttgaggaccaaaatcgattccaagaagattctgattatgtgttcctttttgtgagtgattcgatgaagttttaaagaaatgtatactacaaaatgaattctgttttacctgcataagcttttagtttatgtttacatacatgacacatgcgtcgtgtccctaaaaagggcgtcatgcataccaaagaggaaaatggcaaacgtttttgctatgataaattgataatgataacaaatgatagtgaagagattaggcaagtgatggcattagtatgtagtactaatacataatacatagtgtaaagttgtatgaggtaacatttgacaaaattgctttgatgagtataaaaatagactccgcgtagttatatattattctgatcattattatttgaatgagaaaattgctcagtaactcagatggttacattttttaaggttccggtcttatgtacttgacattgtatttatgacatcatgtacagatacacagttcactagatcagcgaaaaagtattttactaatattataaatgttgaagtttgtgtgattgtgtgtatgtttgttactcaatcacgtcataatggctgaagagatcggtatgcaatttggaacaggggtatataatggtctggttcaacgggatcgcggacgaagccaagggcagaagatagtttttttaggacacaccctcaatagcaataacacagcagatgaaatcataattgtttagagttagtactcttttcctttgagtataatttattattatttatttatttattaaaaggtacatgttaaaacgtataaactagtgtacagtccaacaaaactatatatctagtttctcaactagtttgtgacgtggaaaggcattaggtaggtatatacgttatgttttttttgcctgaacataatgtacgtacttatccttaatatttaattctaaacgtattatcttttgtttcttttgcttgttcattgtgataattgaaagtaatcagtaaaatattgatatattcaaaaactaattagcaaaataatgtctacagatatgtgctatgtgtgtacctgtagatattttgtacgtatatatgcttaaagagtacataattggtaggtaaataagtaaatgaaatgtgtacttcaatgttaacgtagtaatatcggaaccaaataaaatcatattagttttaaaatattatacgcacctaattagctactaacatatgaaatgatgtaatatcaaacgtaatttcatttttatacggtttatttttcttaggtaatttgctacgaaattgctacgaaacgactacgaaatttaaaaaaaagttaattatcttgcattgcaaactaatagattaattcgtttaagtgtcagaattaataaggtaattagattaacataaaagtatatatgtatcagcatctataatttcgttaaaaagtaaaaaattttggttaaaaagtcaacgactacgtagcaacacctcgaaaaattcatacgaaaatcgaaccatgttgaaaccacgtgtttggcagtcacgtttacaatgcgtacaagtcgtacaacgtgatagccttattcagttatgttttaagtagtttactaccaataatatatataaagcactgtatacatactatatgtgaggaagactcccccaaacaagtcacgtttccctcaatttctaacaagtgcttgtttatacttgattgttcaattaaaacagttctatcgcttaacgcactcgctatgaagttctattgattaagttcgttaggtgcattctgagtgcaactactgacattttatgagtgcaattactactactatagatgagtgtccgtctagttgtgctcgaaatgtagattttgtatagatttggtatttactttaaaaaaagtactactgggcttttttcggttattcccaaatttctcattcaaattgtgcccagtatatggcaatatgctcaccccctgttacatgggacttattatactaatggtgggtgtatattgtatagtggcattacgtgctgtaatgagcacctctacctaccctttcgcggataaaacgcaaaacgatggaccttaaaataaaacgttacacagttgataaagcctaatttctttaaatttggatctaatgcacagtcgcattaccagtgtaatttatgtttgtttacacctaacacaggggataaaatccacgaaatcctttttaaataacggagagattaaaatgagttaacagttcggaaacaatattaaagattgaaatcaataagtatgtcaatctaggaatgccttcctacatgttatgacatccgagataaggtcttctagattctgtcatatcttacgtgatattacaattttcttacgtttccatagagttaggtacatgtttttggaaaatacttggaaaatgtaactagacaataataattaatgaaggattaaacgacatgtgataaatataattggtaggttttatctaaccttagattgtctgtatgatagagttatgagcgatagaaagcgctttaactaattcgtacattttgtatcgtcttatccttgtcatgctatattttttgttacttaattgaaacatactatataaagatagttatattcatctaatttatatgattaaaatatatgtatagggtgtcccaaaattaacgcaagatttgaattaaatagaaaacgccgtttttagtcttttaatagttatatttttattgactcgtaaagtacataggatagggttatatatggaataatacataggacaaatggcctccacggctttgttgaaatttgccatgaccattctgcataaatgtggctgaatttcgttgatgcagcgttgaatctcctcctttaatgcacaggtggttgtgggcttgttgacatacttgtgatttcaaataaccccataaaaagaaggtgatgaagggtaatggtgttaaatcgcacgatctaagaggccaaatttgatcaccgaaacgagagagtacacgacctggaaatgtctttaaaatattctttaataatgaagacacgttgttctatcgtgtaacgctccatttttaataaccctatacttttagctgtcaaattgcttttttttcagggttgccaacacttcactgcacaaatgggggcaaattcaaatcttgcgttaattttgggacacccgatagaaggaacattatttctgtattttttaattttaagggcgttgaataaattttctgtaaatatgtattctatgaagcgcagattagttagggctgttgcagtataagtcatataaaaattaagagtagatactaaagataatagtaatctaaagattaggaaagcaataaataaataaatcttattgtttgtatttttggatttaatttatcgaaggtaactgaactttttcacgttttgtaattgctgttttgctgcctttaaagataagatgtgacgcatttattattttcgcactataaaatcaccagtacaataacaagtgaataaaaattattttataagcacatacgtattgaactattatctatctgaatgtttatctctaatttattcttaatcaggaagaaaattaagcttatcgaattgtgataacaatgaaagaacgaattgtaaaatataagtaattaagttacttgtttgaaataatgaaggtattaactaactataactgttgggtaacatgcaggaggcagacgccatcgccttaaaaatgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatagtgaacagtttcgtagtttagaggtaattcgttacatatcccacattggggatctgataattcggggacatgctctctggtaatattatgcgtgagtgcatagtttcatatattagaatacaagcagtgcaatgccacttctgtaccagtatgacatcactgatgagtctcgctctagtcgataaaattgtagcaaaaattgttactaacattttattgtatagttctaggaagttaaagtgctaaaaagaattaggtacaccggcttctgtttgtatacgagaaacatttttccatataatcgtcttatatttgggctggaaacccaacatatttataaacctagttggataaattaattaagtagtcaaagtagtagtttagttatcataaatgtcgtctcaacaactacttgtacattgtagttagaggagaggtctggaggtaagccccaacggccggatcgtacgcattccgtatgacgtcaccagcacgcaacgcatgtaggcattgctgatgatacggtccgtacgatgcggatggccggtgttgtatgaatttctatacaagacaaactaaaatccgttgcgtccgatgcggggctgtagatgcaaaccttaatagtgagaccgtttgcttgtcacgattattttataaatgtttgcataatgtacaagctacagtggcaagtattgtacgtatctgaattacgagtaaataaatgtaccgtacctatattagttgtaattataatgacattccatgacctcttttcgagatttacgaaagggaaatgaaacgaggctatttggactgattttattgtcctaccatattaatgtaccaaatcgcttttgtaaataactaattaaataatttcatactgctttacaaaaattacatcttgtaaacaaagatatgctcaagcgcttatctagcgccaattttgcgttaatatgatgtaaataataataatatgtatgtacctaatatgaaatttgttttttaacttaatatataaataaacttttttactttcataccaaaaatctgtagtactttagaaaaagtatttgtgatgtgtgtaactattttgttttagttttaaattaatttatttgtaacgtatttgtgatcaaatagattgttagataatgtgtaaatgcaataaataaatatgtaccaatcata

SEQ ID NO: 2 - DNA, 12635 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 3 - RNA, 20 nt, Spodoptera frugiperda
ggaagaacuuccugcagcaa

SEQ ID NO: 4 - RNA, 20 nt, Spodoptera frugiperda
gccuaaccuucagugcacca

SEQ ID NO: 5 - DNA, 12634 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtggaaagcttatgttcttatgcatggaaagcttatgttcacgctacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 6 - DNA, 12632 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgaaccctaaccttcagtccatggaaagcttatgttcacgctacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 7 - DNA, 12635 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgaaccctaaccttcagtgcaccatggaaagcttatgttcacgctacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 8 - DNA, 12632 bp, Spodoptera frugiperda; identical to SEQ ID NO: 6

SEQ ID NO: 9 - DNA, 12648 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcatttccatttccatccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 10 - DNA, 12636 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgaaccctaaccttcagtgcatccatggaaagcttatgttcacgctacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 11 - DNA, 12633 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 12 - DNA, 12633 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgaaccctaaccttcagtgccatggaaagcttatgttcacgctacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 13 - DNA, 12632 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 14 - DNA, 12635 bp, Spodoptera frugiperda; identical to SEQ ID NO: 7

SEQ ID NO: 15 - DNA, 12632 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgaaccctaaccttcagtgcatggaaagcttatgttcacgctacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 16 - DNA, 12635 bp, Spodoptera frugiperda; identical to SEQ ID NO: 7

SEQ ID NO: 17 - DNA, 12633 bp, Spodoptera frugiperda; identical to SEQ ID NO: 12

SEQ ID NO: 18 - DNA, 12633 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgaaccctaaccttcagttccatggaaagcttatgttcacgctacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 19 - DNA, 12635 bp, Spodoptera frugiperda
atgcggctggtaccgaagcaggcgagtcccttcgcaaagttccggctgttgatgtggaagaacttcctgcagcaatggaggcacagaacgcaaacagtcctcgaaatattactcccagttctcaccatgacgctggtgctaatcttacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 20 - DNA, 12635 bp, Spodoptera frugiperda
atgcggctggtaccgaagcaggcgagtcccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 21 - DNA, 12634 bp, Spodoptera frugiperda
atgcggctggtaccgaagcaggcgagtcccttcgcaaagttccggctgttgatgtggaagaacttcctgcagcatggaggcacagaacgcaaacagtcctcgaaatattactcccagttctcaccatgacgctggtgctaatcttacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 22 - DNA, 12638 bp, Spodoptera frugiperda
atgcggctggtaccgaagcaggcgagccccttcgcaaagttccggctgctgatgtggaagaacttcctgcaatgccaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 23 - DNA, 12627 bp, Spodoptera frugiperda
atgcggctggtaccgaagcaggcgagccccttcgcaaagttccggctgctgatgtggaagaacttcctgcaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 24 - DNA, 12632 bp, Spodoptera frugiperda
atgcggctggtaccgaagcaggcgagccccttcgcaaagttccggctgctgatgtggaagaacttcctgcagtggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 25 - DNA, 12632 bp, Spodoptera frugiperda
atgcggctggtaccgaagcaggcgagccccttcgcaaagttccggctgctgatgtggaagaacttcctccaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 26 - DNA, 12632 bp, Spodoptera frugiperda
atgcggctggtaccgaagcaggcgagtcccttcgcaaagttccggctgttgatgtggaagaacttcctgcaatggaggcacagaacgcaaacagtcctcgaaatattactcccagttctcaccatgacgctggtgctaatcttacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 27 - DNA, 12638 bp, Spodoptera frugiperda
atgcggctggtaccgaagcaggcgagccccttcgcaaagttccggctgttgatgtggaagaacttcctgcagatgcaatggaggcacagaacgcaaacagtcctcgaaatattactcccagttctcaccatgacgctggtgctaatcttacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 28 - DNA, 12637 bp, Spodoptera frugiperda
atgcggctggtaccgaagcaggcgagccccttcgcaaagttccggctgttgatgtggaagaacttcctgcagtgcaatggaggcacagaacgcaaacagtcctcgaaatattactcccagttctcaccatgacgctggtgctaatcttacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 29 - DNA, 12632 bp, Spodoptera frugiperda
atgcggctggtaccgaagcaggcgagccccttcgcaaagttccggctgctgatgtggaagaacttcctgcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 30 - DNA, 12648 bp, Spodoptera frugiperda
atgcggctggtaccgaagcaggcgagccccttcgcaaagttccggctgctgatgtggaagaacttcctgcaggaagaacttcctgcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 31 - DNA, 12626 bp, Spodoptera frugiperda
atgcggctggtaccgaagcaggcgagccccttcgcaaagttccggctgctgatgtggaagaacttcctgcagcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 32 - DNA, 12632 bp, Spodoptera frugiperda; identical to SEQ ID NO: 24

SEQ ID NO: 33 - DNA, 12636 bp, Spodoptera frugiperda
atgcggctggtaccgaagcaggcgagccccttcgcaaagttccggctgctgatgtggaagaacttcctgcaggcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 34 - DNA, 12643 bp, Spodoptera frugiperda
atgcggctggtaccgaagcaggcgagccccttcgcaaagttccggctgctgatgtggaagaacttcctgcagttgcagtgcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 35 - DNA, 12645 bp, Spodoptera frugiperda
atgcggctggtaccgaagcaggcgagccccttcgcaaagttccggctgctgatgtggaagaacttcctgcagcaacttgccacaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 36 - DNA, 12625 bp, Spodoptera frugiperda
atgcggctggtaccgaagcaggcgagccccttcgcaaagttccggctgctgatgtggaagaactatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 37 - DNA, 12632 bp, Spodoptera frugiperda; identical to SEQ ID NO: 29

SEQ ID NO: 38 - DNA, 12623 bp, Spodoptera frugiperda
atgcggctggtaccgaagcaggcgagccccttcgcaaagttccggctgctgatgtggaagaacttcctgcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 39 - DNA, 12625 bp, Spodoptera frugiperda
atgcggctggtaccgaagcaggcgagccccttcgcaaagttccggctgctgatgtggaagaacaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 40 - DNA, 12634 bp, Spodoptera frugiperda; identical to SEQ ID NO: 5

SEQ ID NO: 41 - DNA, 12633 bp, Spodoptera frugiperda; identical to SEQ ID NO: 11

SEQ ID NO: 42 - DNA, 12628 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagccgtgaaccctaaccttccatggaaagcttatgttcacgctacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 43 - DNA, 12634 bp, Spodoptera frugiperda; identical to SEQ ID NO: 21

SEQ ID NO: 44 - DNA, 12635 bp, Spodoptera frugiperda
atgcggctggtaccgaagcaggcgagccagtcccttcgcaaagttccggctgctgatgtggaagaacttcctcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtgagttatccaaaattctattgcatgtcgctttaataaaactatttaattcaacagttctaaggaaccgtccaccattcttatcattattattatcatgggtttgttttcatcctaagttaggcgtagatctctcaaatagtccgccagtgggctgactgcactactccagtatatctagatttgatgttttataatgtgctcaagcgaatattattcttccgattacgattcatgtttctcatcacaatgacatcaagtatttctgttgttttagtgtaatcagttcacacgcttggctatttacttaaaactttactatgcaatttgctctacattaatgaactgagataaaatcatgatgcaagttgttctgcaaataatttcattttgtgtgacgtatgaaatatactatactaaacgtttttttttttcaggtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggttggtattgtattatttttcctataagggcctgtttcaccacctccatataaataccagataaagggtaattcttcaaaaacaaaaagttaacggcgtcattatccacaaaagttaataattctgctgattaaaacataaaatttggtttcaattaattaagctgtggcactgctctcaagcaatccaataaaaataaggatgataataagctaccaaaatgcttaagaaggcgggtgaataatgatttgttaattgttttttgaaaaatcaccttaaacttatgagacagatagttcacacaaattatgttgttaattcaaatttatctgggttcgtagctgctattcagatgttgtgcaacaggccctcagcttgtattggatctgttgtataattcagctaactgacactgcattattttcttaattttaggcgcagaatcattatccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggtaacgacctttctattaatgtacttaattaatggtacgagagatttatcctatattttttagttaagaaaataatttaagtattccatcttattttatttgttgtgtgcaggttacgtaaacgaaatgttcatagcactgcaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgccatcaacattacaagggcggtcacggtggaaaaggaattgcagctaaaggtaatcttcatacatataatactaaataaaacttgagtttctcttctctagtagtcgtagttgtagtggtccggaggtttaagaccgcttctcattcatgacagttcgaaacctgccaacaacgaatacccatgtgacttatgtgtactttccaaggttaggtatttaagcaccactgacaaacggtgaataaaaacatcgtgaggaaaactgggcttataatttctaattacaaatctgtaaacgccaacccgcattgagtaagcgtggtgattaatgctcaaaccttctccgtgtgagaagagccctttgggcagcagtggccactaaatgttgatgttgttgttgtagttctctaaccaaaactaggaataataattttaaattcacgttacttatgtttttgtaatttttcaggaaacgatgaaaatcatgggtctccctacatggttgcattggactgcatggacttgtaaacagtttgttttcttgttagtatccgcaagtctgacagtgatacttttaaaagtaagtttgtatttcaaattagatttcattctaccattttggtttcacctactttacctataaatggtttcttttatgttttagataaattggttcacaaacgaagacggtttcagtgagtacacggtgtttactaacacgccttggacagtcttgatgtttttcacgatgctgtacttaacttgcgtgatctttttctcatttatgatgagcagctttttctctaaaggtatgtatattatctattattagttgtttagtagttttatgacttgtatgatgttggtacatatgatttatttttgtttcattttatgtagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggtaagatgtcaaatttattttaaggtagcgtttttttttcattgtatatgtagtctggacattacgattacttttagtaggtccctacttcgaattaagtacggaaataatacgtatcaataattactttagtacaaacctattcacttatgcaatatggtatgatagtgacatactgagtatgaacgtaagaggataatgtacgtagcgactgcagcatgcatgagtacctactaaattgctgatcatattccttcaactaggcttgcagtggggcgacttcatgtcggcaccaggcacggactcgaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttccctcattataaaccaggtgaagatcagtgattttttaaatttattattcaataaaggtttaaattttgaacctaaattaatggtttgtttttctttttcaggtacagttttggttttggaaaatgaaaacagtgaatttgaagacatcataaaggaaaaagaacccaatgaacacgaagtgggcgttaaaatgaatgtaagtgtgaactatcttaaatctgagaaacttgtttccgataactccctcttgcactgatcaatgatcgaccattctgacacaattgaaatagcagactgagctatactacctacatagctccgtccctcttgcactgatcaatgatcgaccattctgacacaaatgaaatagcagactaatgcccctgcttaatctgttctattataatgtaaacatccccttaactatgtactttattcacagaatttaacaaaaatctttggagctaacactgcggtcaacaatttgtctttgaatatttacgacgatcaaatcacagtattacttggacataatggtgctgggaaatcgaccacaatatcaatgttgacaggttcgtatattttttgttgcattaattctatgtattcatttatcataagatagattgctttatccgtttttatttacctacatacataaaattatttaggtacttatttggtttaatcaagttgaaaactgaacacgtcacttctagtaatgtaaattataagtagttgtctgcagttacctcataaaattaaggaagtagggaggtaatgttaaattacgtcgcagagtgggtgcatagcaattgtcacatctgcgccaggcaagcaacggaactcttacgcaatcacattactgtagactagcccactggctttaatgtaggtaatgttactaggttaaatacaattgaaggtcttcaaaacgattgcaattttagaattacgtatgcggatattattatttttatatattatttttaaacttactgtgatttttaatattttaggtaatttggaggtaacccggggtactgtgactgtcgcgggatatgacatgacacacgaaacttatgcggctcgtgcccatatcggcttatgtccgcaacacaatgtactgtttaacgaactcactgtcagagaacacttggaattctttgccaggttgaaaggatttaggggagcagagctcaagtctgagattgatactcttatcgaaaagttggaactacaagacaaggtttgttattaataattatctacttaatgtatgtgaagacttacgctatgttttttttcttcaacacacttatgttcatcattcttacagcgagactatccctctaatggtttgtctggaggtcaaaagcgacgtttatgtgttggaatagctttaagtggagcagcacgtgtggtactacttgatgaacctacttctggaatggatccttcttcccgacgagctctttgggaacttctacagaaggagaagaaaggtaacagatcaaaactcttaatacaaaaaagtaatttcatagatttttcaaaactctaactcaaaatctttatgtgcatgtcttaatttaaatatttttaacaacttaacggcctttttcaagcgcctttaacaacaattctaataagttgtttatgtttaggtcgatcgatgatcttgacaacacatttcatggacgaagctgatattctcggtgaccgcgtggcaattatggcacaaggccgcctgcagtgtgtgggttcaccttatttcctgaaacgtcattatggcgtcggatacactctggtagtcgttaaggacgatgactttgatttcgaagaatgcactagacttataaataaatacattccagacacggttgtcaaggaagatcgcggtaagttagtcataaattaaacctttgtaatctatctaccgtactcgggagatatttaatgattacttaaactattacttagtaaagattttctgtagaaaacaattgctaaggactgggttaaataaccattaaattactctaagtgtggcggtatattcaataacagttagttgcgcagaaaaaaacccttaaaaattaatgaatttttaaatgtctttttataggtacggaaattacttataacttaatcaacgattattcatacgcctttgaagaaatgctgaacgatttggaatgtaatatggaaaagataaaatacaaaaactatggtttaactgctactactttagaggatgtgtttatgtcgtaagtaactatttatattctagttgcggaccaattataggtacctaatagtttactaatcgaatattttgattcacagagtcggttcggacttggcaccggtaaataattcagataacgatgacgctgttactactacgaccgactcgaccattgacgatattttgaaacacgaacttgattcgtctttggaagaatgtaagtagtatgagtttacaaatgatcggacgttacagaaaagcgtctacaggtaggtacacatcgcacgcattccgtatgacgtcatcggtgcgcatcacatgtagtcattgccgatgatgcggttcgtacgattcggatcagtggtatgagtttctatagaagacaaactaaaatccgttgcgtgtgatgcgtacgatgcggacctgtggacgcttaccataagtctttgcaagttaacctttaaccgtttacattatccagacttccagcctagcaagacttatgaacaagttattaaaacagtttattttgtttcagtggatagagacgaaagcagtgtgaccggtttccgattgctgtgtcagcaagtattagcagtgtggatgaagaagggactgacactgattcgttcaccttggttgatgatcttgcagttcttcgctcccgtcatactcatcaatgccacgcttggagttatgagatacgtgatgtccttaaccccaactataagatcaagatttctatcattgactgaagggtgagtcatacatttttatgttagattatgtgaaagagattagattaagttaataacagagtgcggttttcggaatgtcgttctttgtgacgttattgattgtcaccgaattattttaagtccaaaggttttaaggtacaatccattgagcccacttgcgctatgtattttatgctagtatgtgctattatatatcgtgcttaaggaggaatgtaaattttataataaaataaacaggtgaaaattgaattccagtattataaaatacgataataattttaatttcagattcacgagtacagaaaccttgttaagtttcaacggtacattaggatcatctgtcggcgctatcgcggcagcagcatacgagatgatgttcacggcctcagacgtggaaaacatgggcgtgactcacattgggaacgtacccatggacgagtattatctaaatagggtaagttgcaaaatgatgacgcataagtgcacattatccggtagcacatagctagctaaaaatgtattatttgatttcaaaccccacgtactgattaaaacagtgattttaattgtgataattataataatatctaatctagtgtgatagacaagcttttaaacgatacaacggtttttacgtatgtaatcaaaagaaaactctttagttttcacgctgtaaaaatgtaatcttagtttacttatctgtatgttctgttttgtgtttttagacgatggatccagtggtgatggggcagttacgtcaccagatcctgattggttccactttcgacgataacaatgcgacactttggttcagtaacttcggttaccacgacgtcgctatagctctatctaccttccactcggcttttcttagagcattcaactctactgcgcagcttaacgtttacaatcatccattggaggctacttatagagaccaggttagtaaattattattattttctcatctaaagtagaggtgaaccattgccatcgtaatccttgactagtgcgactggttcggttccgtctggatttggctctttcgaccactctattcagattcgacaagtcaatcaactgttttcagatttctactagtttacttagtcttttcttatttggataatttgaatgatttcagacggacatgcagatgatgattgccatgctctccatgcagctgtcttctggtattggtagcagcgtcagtatcgtcagtgctgtattcatcatgttctttattaaggtacgtttattttatttctaatggctttaagtattctgcagtacgccgttattttaataaaagactttcatattgacctataagtttgtaaatcgaggggctaattacgtgaaagccatctttagaagaccgtcttcgcagggagaagaatatattaccacagacttgacactatgttttagaaaattggttgtgacttgtgataaattctaacctttggcgccccacgttgggtgccaatttagcatgtgctttattttaacaccaagccaaaaaattacttgttcgctgataactccgtcattcaaaccgtcatattttctcatgtgccacatggctgcctgccagtgtgtgacgacgcctagcctgccagtgcatgcgataaaacctcatcgctacaatacttatttgttatttgcaggagcgcacatctggcgctaagctgttacagaaggccgcgggagtgcaaccagcagtgctgtggggtagtgctgctgtcttcaactgggcttggttcctgatcacctgcgtttccatagtaatcacttgtgccgctttccaagttattggactgtccactgctcaagaattaggtaattaatctttgtaatggaaaaaagataaaaatcctccattgcgtggagagttattgtacaaaatgtggctgcagttttccatttaaaacaaagtacttcgtgattccgatagatttggcatttgattgaccagtatggggactggtctctatagaacacattcagaagttgttgaaatttatattacattcttctaaataaatacactcgcgctttcaaacgctgcaagtataccaactacaaggtatttaatgtaaacttattaacttacacattttcatacgagatgtttggtttcagctcgaatgtacttgtgcgtaatgctgtacggtgctgcaatgttgccgctggtgtacatcctgtcgtttgcgttcaatggacctgctgttggcttcgtcggttattactttatgaacgtgctttttggttagtaacgcgcaatgattttcaaatgtttcaatagttagtggtagaattgtttcgtacattttgagaaatttatagttgattttacaacaaaatacttaattgtgtttttgtgtatcaggtatgatgggtgcacaaatagtggaagccctgtcttctcctcagctgaacacagcggaagctgcgaatatacttgactacatactgcagttcttcccgctttacagtttaatcactgcagtcaggtaagaacaaccaacttattcatgaagctaaattattttctcatatgaaaactattatgaaatatgcaaagtagacgattttcatgcatttaaatcgtatctttacaatacggcgattgtcaacaaatttcgatctccacagtaatcgtcaattgaacaagcggtggccttgcaaggcacacagaaaagtttttgattggtaatttcagtttgaaaatattttccttcctaacttcctcttggtactggtaatttcagatttttgaaccaagttgggctgcgtgaatacacttgtctacaaatgtgcgagtactatcaagctgtgtcgcctaaccttcagtgcaccatggaaagcttatgttcacgcaacgaagaatgctgtggtgagtacttataatttctcataaaaaccaaaaccatttattttaactgtcagatgattgatatacaggtgataatttatatgttcgaatattttaattccagtcgagccgaatgtttatttcaaatggaatcagccgggcgtatcgcgatacttgacaagtatgattatatcctgcatcgtgttctggacgattcttatgatcatcgagtacagagtcttccagaaggtttgtaaagttacattttagaatttatttctttaaactgtatctatttccttaaacactttttacaaagtattgtaggtatcttacataggttattcgtaatactaaacgacatacacatacatatcgtcacccctttaatcccagaaggggtaggcagaggtgaacattatggcacgtaatgccactgtacacccacttttcactatttatgttgttagccatataccgggcacatttctagactccgtgctaccactgtcaaattttcgaaaaactgaaaaaagcccagtaatacttcgcccgacccgggaatcaaacccgagaccccttacccggcagtcgcacttgcaaccactcggctaacgaggcagtaaactaaacgacattgtcccaaaaaatactctttgattaatttcttatcttttgttacagttatgtacgattaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacgggaaacatcttgccgttaatcaaatctcatttggtaagtttttttcctcttcatctattggtagaagagtaatataaatatctatatttttgaggtatcatgctatgcaatatatgccaagtgccaactaaatgtttttctttctttatgagtttaatgtttttattttaatgtcaatcttgtagattattttaaaatattagacacgtattttaatttctttacggaaacaaatacttttgaagatatatcgatttggaatatcgcgtgacgtcacttttgagtacgttttatactcaatagtgacgtagttagctcccactcctaaactttgacacgttttatgtaagcattgttatcttatatgacgaaataaaaacatatgtgtctaatagtttttcattacctaactgacggactgaatacatttttaattttcataccccgtcatctactattaatgtttgttgtttttaggcgttaacgacggcgaatgtttcggtctactgggtgtaaacggtgccggtaagactaccaccttcaagatgttaatgggtgacgagtctatctcaagcggtgaagcctttgttagtggacactctgtggagaaaagccttggcaaagtacaccagaatatcggttagtataaactggagacaaataagtttcctataatcttattttcacttttaattaaacggagtttatgttctacctacatgtatatacggtttatttcaggttactgtccccagttcgatgctttgtttggtgagctcacgggccgcgagacactacatatgtttgctatgatgaagggtctgcgtttacgcagtgctgcaccaaccgctgaaacattagcacatgctctcggtttcctcaaacatcttgacaaaagggtaaattatattttcaaaaataaaccaaaatattttaaactgcgacctgcaaactcaagaagctgagattatggcaaaagccgccgttttagaggacgcctcataagtcataatccagtagcacattatcattgaccgttgataatgtattcaaacccatattttgtttacataaaaaatcaattatttagattgcctaattttttaagccgagataagatatatgaccttacctacttaggtaattatttagcgatacgcattataatacgtcaataacaaagtatttccttttcaccattgtaggtaaatcaatattcaggaggaacgaaaagaaagttaaacacggcgatagcattcttgggacgaacgcggcttgtgttcgtggatgagcccaccactggagtagatcctgccgctaagcgacatgtgagtataatatacgtatatatacatgttaaatgcatttcactgaagaaatttaagattcttctctctctgtcctaccgaagtaatcaggaaagggtcatgaaagagatagggcacttcccaagaagtcctattttggtctaaattaaaaggcacaaaacgagttataatacactgagtagttttttgagatatctgtatcaatatattctgatatatgtttttatttacataggtatggcgagcaacgcgtggcgtacagcgtgctggccgcggcgtagtgctgacgtcacacagcatggaggagtgcgaagctctttgctcacggctcactatcatggtcaacggacggttccagtgcttcggcacaccgcaacatcttaagaacaaattttctgaaggtacgagaacaatttttatcagtcactacctaaatagatatcacacttatctcaaaagttacataagtctatctcgatgtttaagtatcaattttcgattgcttatctacgacacctgacaacctggcaaaactagatcagcacttgaaattaatgctgatgacgacgtatttattgttgttttattttgttagtatgccaattttaataattattaaaatgttgctttcaggatttacgttaattattaagatgaaaatggaagacagagacaatgacactgcttcgataaacagctcacgtagtgtagtggacactgtcaaagaatatgttactcaaaacttccagaatccacgtatcatgtaagtacatttaattcgtaccctaaaccatgctatataaaaataaaaattaacttttagaagcggttaactagttccgcgcgcgcaaatgctataaatacaaatgctacgccgtaggcggttgctacgaaatatcagaaatgtgtaattaggacaatgttttggagatttttgttttaaaattatttattaatttaaatattatacagggaggaataccagggactcctgacatactaccttccagaccgtagtatggcatggtcacggatgttcggcattatggagcgtgctaagagggacttggagattgaagactacagcatctcacagactacactagaacaaatattcctacagtttacaaagtaccagcgacaagcattcgaattactatag

SEQ ID NO: 45 - DNA, 5208 bp, Spodoptera frugiperda
atgcggctggtaccgaagcaggcgagccccttcgcaaagttccggctgctgatgtggaagaacttcctgcagcaatggaggcacagaacgcaaacagtcctcgaaattctactcccagttctcaccatgacgctggtgctaatcctacgatggcagatagaaccagcagaaagagaaacacaaacctatccgcctttcagagcaaacacgctcaacttttccactgttgtactgtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggcgcagaatcattgtccaataatttgtcgtactctctgagattccccgagagacctcgtcttaattcgttattccaaactggaggtcgcacttggaggacagacgcagttttccctgttttcgaaacgcctggtccacgattttcgaagtcttgggaaggtggtaacgatccaggttacgtaaacgaaatgttcatagcactgcaacaagttatttcaacggaattgatatcgaggtccacaggagtgaacatgagtgagttcacagtgttcctgcagaggtatcctcacccgccatacatcagggacatggcgcttgaccttctgcagttcatgttccctatgttcatcatgttgagcttcagttacactgccatcaacattacaagggcggtcacggtggaaaaggaattgcagctaaaggaaacgatgaaaatcatgggtctccctacatggttgcattggactgcatggacttgtaaacagtttgttttcttgttagtatccgcaagtctgacagtgatacttttaaaaataaattggttcacaaacgaagacggtttcagtgagtacacggtgtttactaacacgccttggacagtcttgatgtttttcacgatgctgtacttaacttgcgtgatatttttctcatttatgatgagcagctttttctctaaagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggcttgcagtggggcgacttcatgtcggcaccagggacggactctaatcgcttcgtgttcggccacgtggtcatcatgttagtggtggactgcttcgtctacatgctcgtcaccctctacttcgaacaagtgatgcctggaccattcggcacgcccaaacgctggtacttcccgttccagttgcgattttggttccctcattataaaccaggtacagttttggttttggaaaatgaaaacagtgaatttgaagacatcataaaggaaaaagaacccaatgaacacgaagtgggcgttaaaatgaataatttaacaaaaatctttggagctaatacggcggtcaacaacttatctttaaatatttacgacgatcaaatcacagtattacttggacataatggtgctgggaaatcgaccacaatatcaatgttgacaggcaatttggaggtaacccggggtacagtgactgtcgcgggatatgacatgacacacgaaacttatgcggctcgtgcccatatcggcttatgtccccaacacaatgtactgtttaacgaactcactgtcagagaacatttggaattctttgccaggttgaaaggatttaggggagcagagctcaagtctgagattgatactcttatcgaaaagttggaactacaagacaagcgagactatccctctaatggtttgtctggaggtcaaaagcgacgtttatgtgttggaatagctttaagtggagcagcacgtgtagtactactcgatgaacctacttctggaatggatccttcttcccgacgagctctttgggaacttctgcagaaggagaagaaaggtcgatcgatgatcttgacaacgcatttcatggacgaagctgatattctcggtgatcgcgtggcaattatggcgcaaggccgcttgcagtgtgtgggttcaccttatttcctgaaacgtcattatggcgtcggatacactctggtagtcgttaaggacgatgactttgatttcgaggaatgcacaagacttataaataaatacattccagacacggttgtcaaggaagaccgcggaacggaaattacttataacttaatcaacgattattcatacgcttttgaagaaatgctgaacgatttggaatgtaatatggaaaagataaaatacaaaaactatggtttaactgctaccactttagaggatgtgtttatgtcagtcggttcggacttggcaccagtaaataattcagataacgatgacgctgttactactacgactgactcgaccattgatgacattttgaaacatgaacttgattcgtctttggaagaattggatagagacgaaagcagtgtgaccggtttccgattgctatgtcagcaagtattagcagtgtggatgaagaagggactgacactgattcgctcaccttggttgatgatcttgcagttcttcgctcccgtcattctcatcaatgccacgcttggagttatgagatacgtgatgtccttaaccccaactataagatctagatttttatcattgactgaaggattcacgagtacggagaccttgttaagtttcaacggtacattaggatcgtctgtcggcgctatcgcggcagcagcatacgagatgatattcacggcctcagacgtggaaaacatgggcgtgactcacattgggaacgtacccatggacgagtattatctaaataggacgatggatccagtggtgatggggcagttacgtcaccagatcctgattggttccactttcgacgataacaatgcgacactttggttcagtaacttcggttaccacgacgtcgctatagctctatctaccttccactcagcttttcttagagcattcaactctactgcgcagcttaacgtttacaatcatccattggaggctacttatagagaccagacggacatgcagatgatgattgccatgctctctatgcagctgtcttctggtattggtagtagcgtcagtatcgtcagtgctgtattcatcatgttctttattaaggagcgcacatctggcgctaagttgttacaaaaggccgcgggagtacaaccagcagtgctttggggtagtgctgctgtcttcaactgggcttggttcctgattacctgcgtttccatagtaatcacttgtgccgctttccaagttattggactgtccactgctcaagaattagctcgaatgtacttgtgcgtaatgttgtacggtgctgcaatgttgccgctggtgtacatcctgtcgtttgcgttcaatgggcctgccgttggcttcgtcggttattactttatgaacgtgctttttggtatgatgggtgcacaaatagtggaagcactgtcttctcctcagctgaacacagcggaagccgcgaatatactcgactacatattacagttcttcccgctttacagtttaatcactgcagtcagatttttgaaccaagttgggctgcgtgaatacacttgtctacaaatgtgcgagtactatcaagccgtgaaccctaaccttcagtgcaccatggaaagcttatgttcacgctacgaagaatgctgtgtcgagccgaatgtttatttcaaatggaatcagccgggcgtatcgcgatacttgacaagtatgattatatcctgcatcgtgttctggacgattcttatgatcatcgagtacagggtcttccagaagttatgtacgatcaagaagaccccaccacctctagacgagagtatactggacgaggacgtgcaaaaagaggcgcagcgcgcgcgcaacgtgttgccctcgcaacgctacgagcatgcgctgatcgccaacgatctctccaagtactacggaaaacatcttgccgtaaatcaaatctcatttggcgttaacgacggcgaatgtttcggtctattgggtgtaaacggtgccggtaagactaccaccttcaagatgttaatgggtgacgagtctatctcaagcggcgaagcgtttgttagtggacactctgtcgagaaaagtcttggcaaagtacaccagaatatcggttactgtccccagttcgatgctttgtttggtgagctcacgggccgtgagacgctacatatgtttgctatgatgaagggtctgcgtttacgcagtgctgcaccaaccgctgaaacattagcacatgcactcggtttcctcaaacatcttgacaaaagggtaaatcaatattcaggaggaacgaaaagaaagctaaacacggcgatagcattcttgggacgaacgcgtcttgtgttcgtggatgagcccaccactggagtagatcctgccgctaagcgacatgtatggcgagcaacgcgtggcgtacagcgcgctggccgcggcgtagtgctgacgtcacacagcatggaggagtgcgaagctctttgctcacggctcactatcatggtcaacggacggttccagtgtttcggcacaccgcaacatcttaagaacaaattttctgaaggtttcacgttaattattaagatgaaaatggaagacagagacaacgacactgcttcgataaacagctcacgtagtgtagtggacactgtcaaagaatatgttactcaaaacttccagaatccacgtatcatggaggaataccagggactcctgacgtactaccttccagaccgtagtatggcgtggtcacggatgttcggcattatggagcgtgctaagagggacttggagattgaagactacagcatctcacagactacactagaacaaatattcttacagtttacaaagtaccagcgacaagcattcgaattactatag

SEQ ID NO: 46 - DNA, 4080 bp, Spodoptera frugiperda
atggatacaaagaaaggaagtaaaaatgactcgaaatccaaaccgccgccgcctaaaccaaagagtgtgccaaacgtgtttaagaggacgttgttctgctggatgctgcctatattttactttggcaaccgcagagacctggaggaaagtgatcttccacctcccaagaatatgtatcaatccaagatgctcggagataaattggaaaggagttggctgaaagaagaatatgaagcgaaactagccggacgaaagccgaaatttacgaaggttttattcaaaacattcatctggtcttatataccgggcggtttgatgcaggctacctcaataggtttacgtacggcatctccgctgctgttcagccaactgctccgatattgggcagctgactccccggtggaccggaagacggccatgtactacgcgatcagtatgatcctcgccaactgggcgtcatccttcatgaaccaccacggagtactgttctgtcagcagttcggtatgaagctgaggtgtgccgtcggatctttaatgttcagaaagataatgcgtatgagcaacggctctctaggtgacactgcggcgggtaaggtagtgaacatattatcgaacgatctgcagaggttcgacttgtcaatggtgttcctccactacgtatggattattccgctacaaattgccgcagtcatatatctgggctacctacaagctggaaccgcggctttcattggattcgctgccttaatcatcatagcgttaccattccaaggtggtttgggccagtaccttggtaaaattcgacttcgcaccgctgaaaaaacagacaacagaattaaaatcatgagcgaagttataaacggaatacaggtgattaaaatgtacgcatgggagattcctttccaaaaagtggtcggtcagaaacgtgcggaagagctgaaggaagtgaagattgcaaccatcctgaggaccgtgttcttaggatttatgatgttcacggaaagagctgcgcttttcttcaccgtcctcacttatgtcttgttggggaacgttatgtctgctaatgtgttctacccgctgcagcaatttatgagcgccgctcaagtaaacattacattaatcttgcctatggtgctatcgttcactgctgagctcttagtgtcccttggaagagtcgagaagttcctgttactagaggacaggccagacttgaaggggcatccggaagaaacatcgtccaatttattccgcaacatgtcggccgatggcattccggagaccaacgggtctatccgaccgctctcttaccatcggaaatctgaagcatcaccaatagagccgggtagtgagattcagctgaaggttcctaagtttacacggagtgtatcgtatcaggaggactcagcgctggtgttgcacgatgtgtcggcgagttggaccggggaccccaacatgatggcgctgaagaacatctccatgcgactgcggaaggggaagctgtgcgctatcattggtgcagtcggttctgggaagtcctcgattttgcaactactactaaaagaattgccctcggcgactggcactatttcaatatacggcaagatgtcgtacgcttgccaagaggcgtggctgttccccagcactgtccgggagaatatacttttcggtttgccgtttgaacccggaaaatataagaaggtgtgccgagtgtgtgcactcgagaaggacttcaagcagttcccgtacggggaccagacgttggtgggggagaggggggtgtccctctccggaggccaacgtgcccgaatcaatttggcgcgcgctgtttacagagaggccgatatttaccttctcgatgatccgctgtcggctgtggacgctaacgttggacgtcagctatttgagggatgtatcaacggttacctgcgtgggcgcactcggatcctggtcacacatcagattcacttcttgaaagctgctgattacatcgttgtattaaacgagggccgtattgaaaacatgggaacatttgacgaattggtttcgtccggcaaagaattctcaatgatgctcgcccagctacaggaaggcaaagataaggacacggagagtgttggctcacggagtatcgaagaaaaagaaaaaccaactctaaagaccatgatcagtgtgaatgaaggcgaggaggtacaagagtttgaagcacagaagatgaaggaagaagagagacaatctggcaacctccgctgggaggtgatctctgcgtacttccgatcgggaggacacgtctgtttcatcttatttgcactcttggtcgttgtactggccactacctgcgccgcttctgttgactactgggtcagttattggaccaatcaaatggctgcatatgaggagtccttgggcggagaaagtatcgagcctggcctggacgtgcaggcaggtcggttcacagtgggacagtatctgataatccacggctgcctggtggctgccttggtgttgatggtcaacctgcgagtcttccccttcgcatacctctgcgtctccgcctcagccaagctacataaccagatgttctcgactatgctgagaggagtgatgaggttcttcgacaccagttcgtcaggtcgtatcttgaatcgttttaccaaagacatgggttctctcgatgagatcctgccccgtaccttactcgatgtactacagatctacggaacattgactgctatcctggtactcaacgccattgccctttactggaccctggtaccttcagcagtactcctagtgttattcggctttatggtacgaatatacttgaaggcagctcaaggcattaaacgattggaaggcacaacaaagagtccaatgtttggaacagtgacgtcatcgttgagtggtatttccactatcagggcatccaatgctcaagagagattgatagaacagtttgacatcaaccaggatctgcacactacttcgtggaacagttacttgaatggaggaacgacgtttggtttctatttagatacaatgtgtctggtgtacatgacgactatcatattcgtgttcctcttcatcgatttcggggacgccatcccagtgggcagcgtagggctagcggtgacacagagcaacacgctgacgctgatgttgcagcacggcgcgcggatgttggtcgagttcctcgcgcagctcaccagcgtcgagcgcatcctcgagtacacgcgcatcgacaccgagccagacttgttccaaggaaaggttgaaatgccgccaaattggccctaccaaggaaggatcgagtttcagaacgtttctctacggtacgctccaaacgaacaacccgtccttaaaaatttgaacattgttatcgaaagcggaaacaagatcgggatcgtggggcggacgggcgccggcaaatcttctttgatatcagcattattccgattcgcctacctcgacggattaatatccatagatggactcgatacttcgctgatttcgagacagggactgcgatcgaaaatttcaattattccgcaagaaccgatcctgttttctgcgacaatcagatacaatttggatccgtttgacatttacagcgacgacgacctctggagagccctcgaacaggttgatttgaagtctgctgtaccgtccttggacttcaaagtaacagaaggaggttctaatttctcagtgggccagcggcagctgatgtgtttggcgcgcgctgtgttgagatccaatcagatcttaattatggacgaagctacggcgaacgtagatcctcagacggataacttcattcaggagacgattcgccggcagttcgtgtcgtgcaccgtgctgacgatagctcacaggttgaacacgatcatggactccgacaaggtgctggtgatgagcagcggccaggtggcggagtacgaccacccatacgtgctgctctccgaccctaacagtcacttctctgccatggtgcgggagaccggcgagaagaacagtgctaacttattccaagtagccaaagacgcttacttccaaagtaatctgaaagaaaacgcgagataa

SEQ ID NO: 47 - DNA, 4092 bp, Spodoptera frugiperda
gtgaatacaaaaatggatacaaagaaaggaagtaaaaatgactcaaaatccaaaccgccgccgcctaaaccaaagagtgtgccaaacgtgtttaagaggacattgttctgctggatgctgcctatattttactttggcaaccgcagagacctggaggaaagtgatcttccacctcccaagaatatgtatcaatccaagatgctcggagataaattggaaaggagttggctgaaagaagaacatgaagcgaaactagccggacgaaagccgaaatttacgaaggttttattcaaaacattcatttggtcttatataccaggcggtttgatgcaggctacctcaattggcctacgcacggcatctccgctgctgttcagtcaactgctccggtattgggcagctgactccccggtggaccgggagacggccatgtactacgcgatcagtatgatcctcgccaactgggcgtcatccttcatgaaccaccacggagtactgttctgtcagcagtttggtatgaagctgaggtgtgccgtcggatctttaatgttcagaaagataatgcgtatgagcaacggctctctaggtgacactgcggcgggtaaggtagtgaacatattatcgaacgacctgcagaggttcgacttgtcaatggtgttcctccactacgtatggattattccgctacaaattgccgcagtcatatatctgggctacctacaagctgggaccgcagctttcattggattcgctgctttaatcatcatagcgttaccattccaaggtggtttgggccagtacctaggtaaaattcgactccgcaccgctgaaaaaactgacaacagaattaaaatcatgagcgaagttataaacggaatacaggtaattaaaatgtacgcatgggagattcctttccaaaaagtagtcggccagaaacgtgcggaagagttgaaggaagtgaagattgcaaccatcctgaggaccgtgttcttaggatttatgatgttcacggaaagggctgcgcttttcttcaccgtcctcacttatgtcttgttggggaacgttatgtctgctaatgtgttctacccgctgcagcaatttatgagcgccgctcaagtaaacattacattaatcttgcctatggtgctatcgttcactgctgagctcttcgtgtcccttggaagagtcgagaagttcctgttactagaggacaggccagacttgaaggggcatccggaagaaacatcgtccaatttattccgcaacatgtcggccgatggcattccggagaccaacggctctatacgaccgctctcttaccatcggaaatctgaagcattaccaatagagccgggtagtgagatacagctgaaggttcctaagtttacacggagtgtatcgtatcaggaggactcagcgctagtgttgcacgatgtgtcggcgagttggaccggggaccccaacatgatggcgctgaagaacatctccatgcgactgcggaagggaaagctgtgcgctatcattggtgcagttggctctgggaagtcctcgattttgcaactactactaaaagaattgccttcggcgactggcactatttcaatatacggcaagatgtcgtacgcttgccaagaggcgtggctgttccccagcactgtccgggagaatatacttttcggtttgccgtttgaacccggaaaatataagaaggtgtgccgagtgtgtgcactcgagaaggacttcaagcagttcccgtacggggaccagacgttggtgggggagaggggggtgtccctctccggaggccaacgtgcccgaatcaatttggcgcgcgctgtttacagagaggccgatatttaccttctcgatgatccgctgtcggctgtggacgctaacgttggacgtcagctatttgagggatgtatcaacggttacctgcgtgggcgcactcggatcctggtcacacatcagattcacttcttgaaagctgctgattacatcgttgtattaaacgagggccgtattgaaaacatgggaacatttgacgaattggtttcgtccggcaaagaattctcaatgatgctcgcccagctacaggaaggcaaagataaggacacggagagtgttggctcacggagtatcgaagaaaaagagaaaccagctctaaagaccatgatcagtgtaaatgaaggcgaggaggtacaagagtttgaagcacagaagatgaaggaggaagagaggcaatctggcaacctccgctgggaggtgatctctgcgtacttccgatcgggagggcacgtctgtttcatcttatttgcactcttggtcgttgtactggccactacctgcgccgcttctgttgactactgggtcagttattggaccaatcaaatggctgcatatgaggagtccttgggcggagaaagtatcgaacctggcttggacgtgcaggcgggtcggttcacagtgggacagtatctgataatccacggctgcctggtggctgccttggtgttgatggtcaacctgcgagtcttccccttcgcctacctctgcgtctccgcctcagccaagctacataaccagatgttctcgactatgctgagaggagtcatgaggttcttcgacaccagttcttcaggtcgtatcttgaatcgatttaccaaagacatgggttccctcgatgagatcttgcctcgtaccttactcgatgtactacagatctacggaacattgactgctatcctggtactcaacgccattgctctttactggaccctggtaccttcagcagtactccttgtattattcggcttcatggtacgaatatacttgaaggcagcccaaggcattaaacgattggaaggcacaacaaagagtccaatgtttggaacagtgacgtcatcgttgagtggtatttccactatcagggcatccaatgctcaagagagattgatagaacagtttgacatcaaccaggatctgcacactacttcgtggaacagttacttgaatggaggaacgacgtttggtttctatttagatacaatgtgcctggtatacatgacgactatcatattcgtgttcctcttcatcgatttcggggacgctatcccagtgggcagcgtagggctagcggtgacgcagagcaacacactgacgttgatgttgcagcacggcgcgcggatgttggtcgagttcctcgcgcagctcaccagcgtcgagcgcatcctcgagtacacgcgcatcgacaccgagccagacttgttccaaggaaaggttgaaatgccgccaaattggccctaccaaggaaggatcgagtttcagaacgtttctctacggtacgctccaaacgaacaacccgtccttaaaaatttgaacattgttatcgaaagcggaaacaagatcgggatcgtggggcggacgggcgccggcaaatcttctttgatatcagcattattccgattcgcctacctcgacggattaatatccatagatggactcgatacttcgctgatttcgagacagggactgcgatcgaaaatttcaattattccgcaagaaccgatcctgttttctgcgacaatcagatacaatttggatccgtttgacatttacagcgacgacgacctctggagagccctcgaacaggttgatttgaagtctgctgtaccgtccttggacttcaaagtaacagaaggaggttctaatttctcagtgggccagcggcagctgatgtgtttggcgcgcgctgtgttgagatccaatcagatcttaattatggacgaagctacggcgaacgtagatcctcagacggataacttcattcaggagacgattcgccggcagttcgtgtcgtgcaccgtgctgacgatagctcacaggttgaacacgatcatggactccgacaaggtgctggtgatgagcagcggccaggtggcggagtacgaccacccgtacgtgctgctctccgaccctaacagtcacttctctgccatggtgcgggagaccggcgagaagaacagtgctaacttattccaagtagccaaagacgcttacttccaaagtaatctgaaagaaaacgcgagataa

SEQ ID NO: 48 - DNA, 4041 bp, Spodoptera frugiperda
atgatggacaaatctaataaaaataccgcgtcaaatggcacggctgtgggcgaaccaaaggagagagtaagaaagaaaccaaatatattgtcacgtatattcgtttggtggatattccctgtgctcattactggcaacaagcgtgatgtagaagaagacgatttaattgttccgagtaaaaaattcaattctgaaagacaaggagaatattttgaaagatattggttcgaggaggtagcaattgctgagagagaagacagagatccttcactatggaaagcgatgcggcgcgcttactggctgcaatacatgccgggagctatcttcgtgctgctcatttctggattaaggacagctcagccattgctgttctctcagctcctgtcctactggtcggtggacagcgagatgtcgcagcaggatgctggtctctatgccctggccatgctggggatcaacttcatcaccatgatgtgcacgcaccacaacaacttgttcgtcatgcggttcagtatgaaagtcaaaatcgctgcctcgtcactcttatttagaaagttgctccgcatgagtcaagtgtcagtgggcgatgtcgctggtggaaagttagtgaacttgctgtccaacgatgtcgcgaggtttgactacgcgttcatgttcctgcactacctgtgggtggtaccgctgcaggtcggagtcgtcctgtacttcgtgtacgatgctgctgggtgggcgccgtatgtcggtctctttggagtcatcattttaatcatgccacttcaagctggtctaactaaactcacgggtgttgtgaggcggatgacagctaaaaggactgacaaaagaattaagcttatgagtgaaattatcaacggtatacaggtcatcaaaatgtacgcttgggagaaacctttccagctagtggtgaaggcggctcgtgcgtatgaaatgagtgctcttaggaagtctatcttcatcaggagcatgttcctcggattcatgctgttcactgagcgaagtgttatgtttctgactgtgctgactctagcgctgactggaaacatgattagtgccactctgatttatcccatccaacaatacttcggtattatcacaatgaacgttaccctcattttaccgatggcgtttgcaagtttctctgagatgttgatatccttggaacgtattcagggatttctccttttggacgagcgttcagacattcaaattacaccaaaagtggtgaatggtgctggaagcaaattgttcaacaactccaagaaggagggaggtctcgaaactggcattgtgttgccaacaaaatactcacctaccgaagcgaatattgccagacccatgcaggatgagcctaacatggctgactatccggtgcaacttaacaaagttaatgcaacatgggcggacctcaatgataacaaagagatgacactcaagaatatatctttacgtgttcgcaaaaataaactgtgcgctgttattggacctgtgggatcaggaaagacctctcttcttcagctccttttgcgagaattgcccgtaactagcggcaacctcagcatatctggtaccgtatcctacgctagtcaggagccttggctgttccctgcgacagtgcgggagaacattctgtttggtttggaatacaatgtcgccaaatataaagaggtttgtaaagtctgctcattactgccagactttaaacagttcccgtacggtgacttgtctctggttggggagcgaggagtgtcactgtctgggggtcagagggccaggatcaatttggccagagctgtctaccgcgaggctgacatttacttgcttgacgatcctctatcggctgtagacgcaaacgtgggcaggcaactattcgacggctgcatcaaaggatacctcagcggcaagacatgcatcctggtcacccaccaaattcactaccttaaagctgcagactttatcgtagtcctaaacgagggttccgtcgaaaatatgggctcgtatgatgaattaatgaaaactggaacggaattctcgatgctgctctctgaccaagctagtgaaggctctgacactgacaaaaaagaacggccagcaatgatgcggggaatatcaaagatgtcagtcaagagtgacgatgaggaaggtgaggagaaggttcaagtattggaggccgaagagagacagtcgggcagcctgaagtgggatgtgcttgggaggtacatgaagtcagtcaactcctggtgcatggtggtaatggcattcctcgtgttggtgatcacgcagggtgctgccaccactaccgactactggcttagtttctggactaaccaggtggatggatacatacaaactttacccgaaggagaaagtccaaatcctgagttgaacactcaagtcggtctattaaccacgggacagtacctcattgtccacggcagcgtagtactagccattataatattgacgcaagtcagaatactttccttcgtagtgatgactatgcgagcttcggaaaatcttcataacaccatttacgagaaattgatagtggctgtaatgagatttttcgataccaatccatcgggtcgtgtcttgaacagattctcaaaagatatgggtgcaatggatgagctgttaccgcgaagcatgttggaaacggttcagatgtacctgtctttagccagtgtccttgtgctgaacgccatagccttaccgtggacattgatacccaccactgtgttaatgtttatatttgtattcctattgaagtggtacattaacgctgctcaagctgtgaaacgattggaaggaactacaaagagtccagtgtttggaatgatcaactctactatatctggactctccaccataagaagctccaactctcaggaccgacttctaaactcatttgatgatgcacagaatctccatactagcgctttctacacgtttttgggtggttcaaccgcatttggtctgtacctggacaccctctgtttaatctacctcggaattatcatgtccatcttcattcttggtgatttcggtgagctgataccagttggtagcgtcggtctggccgtcagtcagtccatggtgctgaccatgatgttgcaaatggccgccaagttcactgccgacttcctgggacagatgacagccgtcgagagggtactggaatacaccaagctacctaccgaagaaaacatggagactggaccgacaacgccaccaaagggatggccaagtgctggagaggtgacgttctcaaacgtgtacctcaagtattctcctgacgacccacctgtactgaaggacttgaactttgcaatcaagagtggctggaaggtcggagtagttggcagaactggtgctggcaagtcctcgttaatatcagctctgttccggctcagcgacattacaggcagcatcaaaattgatggcctcgatactcaaggaattgccaagaagcttttgagatcaaaaatatcaataattccgcaagagccagtgttgttctctgcctcgctgcgttacaatctggacccattcgacaactacaacgatgatgatatttggagagcattggaacaggtggaactaaaggagagcataccagccctcgattacaaagtgtcggaaggcggcaccaacttctcaatgggacaacgtcagctggtgtgcctggcgcgcgccatcctccgctcaaataaaattctcatcatggacgaagctaccgctaacgtcgatcctcagacggatgctttgatccagaaaacaatccgtaaacaatttgcaacgtgcaccgtgctcacgatcgcgcatcggctgaataccattatggattcagatcgggtactagtcatggaccagggagtggccgcggagttcgaccacccctacatcttgctgtccaaccccaacagcaagttctcctcaatggtgaaggaaacaggcgacaacatgtcccggatcttgttcgaagtagccaaaacaaaatatgaaagtgattccaaaaccgcttag

SEQ ID NO: 49 - DNA, 4041 bp, Spodoptera frugiperda
atgatggacaaatctaataaaaataccgcgtcaaatggcacggctgtgggcgaaccaaaggagagagtaagaaagaaaccaaatatattgtcacgtatattcgtttggtggatattccctgtgctcattactggcaacaagcgtgatgtagaagaagacgatttaattgttccgagtaaaaaattcaattctgaaagacaaggagaatattttgaaagatattggttcgaggaggtagcaattgctgagagagaagacagagatccttcactatggaaagcgatgcggcgcgcttactggctgcaatacatgccgggagctatcttcgtgctgctcatttctggattaaggacagctcagccattgctgttctctcagctcctgtcctactggtcggtggacagcgagatgtcgcagcaggatgctggtctctatgccctggccatgctggggatcaacttcatcaccatgatgtgcacgcaccacaacaacttgttcgtcatgcggttcagtatgaaagtcaaaatcgctgcctcgtcactcttatttagaaagttgctccgcatgagtcaagtgtcagtgggcgatgtcgctggtggaaagttagtgaacttgctgtccaacgatgtcgcgaggtttgactacgcgttcatgttcctgcactacctgtgggtggtaccgctgcaggtcggagtcgtcctgtacttcgtgtacgatgctgctgggtgggcgccgtatgtcggtctctttggagtcatcattttaatcatgccacttcaagctggtctaactaaactcacgggtgttgtgaggcggatgacagctaaaaggactgacaaaagaattaagcttatgagtgaaattatcaacggtatacaggtcatcaaaatgtacgcttgggagaaacccttccagctagtggtgaaggcggctcgtgcgtatgaaatgagtgctcttaggaagtctatcttcatcaggagcatgttccttgggttcatgttattcactgagcgaagtgtcatgtttctgactgtgctgactctagcgctgactggaaacatgattagtgccactctgatttatcccatccaacagtacttcggtattatcacaatgaacgttaccctcatcttaccgatggcgtttgcgagtttctctgagatgttgatatccttggaacgtattcagggattccttcttttggacgagcgttcagacattcaaattacaccaaaagtggtgaatggtgctggaagtaaactgttcaacaattccaagaaggagggaggcctcgagactggcattgtgctgccaacaaaatactcacctaccgaagcgaatattgccagacccatgcaggatgagcctaacatggctgactatccggtgcaacttaacaaagttaatgcaacatgggcggacctcaatgataacaaagaaatgacactcaagaacatatctttacgtgttcgcaaaaacaaactatgcgctgttattggaccagtgggatcaggaaagacctctcttcttcagctccttttgagagagttgccagtgactagcggcaatctcagcatatctggtaccgtatcctacgctagtcaggagccttggctgttccctgcgactgtgcgggagaacattctgtttggtttggaatataatgtcgccaaatataaagaggtttgtaaagtctgctcattactgccagactttaagcagttcccgtacggtgacttgtctctggttggggagcgaggtgtgtcactgtctggtggtcagagggccaggatcaatttagccagagctgtctaccgcgaggctgatatttacttgcttgacgatcctctatcggctgtagacgcaaacgtcggcaggcaactattcgacggctgcatcaaaggatacctcagcggcaagacatgcatcctggtcacccaccaaattcactaccttaaagctgcagactttattgtagtcctaaacgagggttccgtcgaaaatatgggctcgtacgatgaactaatgaaaactggaacggaattctcgatgctgctctctgaccaagctagtgaaggctctgacactgacaaaaaagaacggccagcaatgatgcgaggaatatcaaagatgtcagtcaagagtgacgatgaggaaggtgaggagaaggttcaagtattggaagccgaagagagacagtcgggcagtctgaagtgggatgtgcttgggaggtacatgaagtcagtcaactcctggtgcatggtggtaatggcattcctcgtgttggtgatcacgcagggtgctgccaccactaccgactactggcttagtttctggactaaccaggtggatggatacatacaaactctacccgaaggagaaagtccaaatcctgaattgaacactcaagttggtctgttaaccacgggacagtacctcattgtgcacggcagtgtagtactagccattataatattgacgcaagtcagaatactttccttcgtagtgatgactatgcgagcttcggaaaatcttcataacaccatttacgagaaattgatagtggctgtaatgagatttttcgataccaatccatcgggtcgtgtcttgaacagattctcaaaagatatgggtgcaatggatgagctgttgccgcgaagcatgttggagactgttcagatgtacctgtctctagccagtgtccttgtgctgaacgcgatagccttaccatggacgttgatacccaccacagtgttgatgtttatatttgtattcctattgaagtggtacattaacgctgctcaagctgtgaaacgattggaaggaactacaaagagtccagtgtttggaatgatcaactctactatatctggactctccaccataagaagctccaactctcaggaccgacttctaaactcatttgatgatgcacagaatctccatactagcgctttctacacgtttttgggtggttcaaccgcatttggtctgtacctggacaccctctgtttaatctacctcggaattatcatgtccatcttcattcttggtgatttcggtgagctgataccggttggtagcgtcggtctggccgtcagtcagtccatggtgctcaccatgatgttgcaaatggccgccaagttcactgccgacttcttgggacagatgacagccgtcgagagggtcctggagtacaccaagctacctaccgaagaaaacatggagactggaccgacaacgccaccaaagggctggccaagtgctggagaggtgacgttctcaaacgtgtacctcaagtattctcctgacgacccaccagtactgaaggacttgaactttgcaatcaagagtggatggaaggtcggagtagttggtagaactggtgctggcaagtcctcgttgatatcagctctgttccggctcagcgacattacaggcagtatcaaaattgatggcctggatactcaaggaattgccaagaagcttttgagatcaaaaatatcaataattccgcaagagccagtgttgttctctgcctcgctgcgttacaatctggacccattcgacaactacaacgatgatgatatttggagagcattggaacaggtggaactaaaggagagcataccagccctcgattacaaagtgtcggaaggcggcaccaacttctcaatgggacaacgtcagctggtgtgcctggcgcgcgccatcctccgctcaaataaaattctcatcatggacgaagctaccgctaacgtcgatcctcagacggatgctttgatccagaaaacaattcgtaaacaatttgcaacgtgcaccgtgctcacgatcgcgcatcggctgaataccattatggattcagatcgggtactagtcatggaccagggagtggccgcggagttcgaccacccctacatcttgctgtccaaccccaacagcaagttctcctcaatggtgaaggaaacaggcgacaacatgtcccggatcttgttcgaagtagccaaaacaaaatatgaaagtgattccaaaaccgcttag

SEQ ID NO: 50 - DNA, 4043 bp, Spodoptera frugiperda
atgatggacaaatctaataaaaataccgcgtcaaatggcacggctgtgggcgaaccaaaggagagagtaagaaagaaaccaaatatattgtcacgtatattcgtttggtggatattccctgtgctcattactggcaacaagcgtgatgtagaagaagacgatttaattgttccgagtaaaaaattcaattctgaaagacaaggagaatattttgaaagatattggttcgaggaggtagcaattgctgagagagaagaccgagatccttcgttatggaaagcgatgcgccgcgcttactggctgcaatacatgccgggagctatcttcgtgctgctcatttctggattaaggacagctcagccattgctgttctctcagctcctgtcctactggtcggtggacagcgagatgtcgcagcaggatgctggtctctatgccctggctatgttgggcatcaacttcataaccatgatgtgcacacaccacaacaacttgttcgtcatgcggttcagtatgaaagtcaagatcgccgcctcgtcactcttatttagaaagttgctccgcatgagtcaagtgtcagtgggcgatgtcgctggtggaaagttagtgaacttgctgtctaacgatgtcgcaaggtttgactatgcgttcatgttcctacactacctgtgggtggtgccgctgcaagtcggagtcgtcctgtatttcgtgtacgatgctgctgggtgggcgccatatgtcggactctttggagtgattatattaatcatgccacttcaagctggtctaactaagctcacgggtgttgtgagacggatgacagctaagaggactgacaaaagaattaagcttatgagtgaaattatcaacggtatacaggtcatcaaaatgtacgcttgggagaaacccttccaattggtggtgaaggcagctcgagcgtatgaaatgagtgctcttaggaaatctatcttcatcaggagtatgttcctcgggttcatgttgttcactgagcgaagtgttatgtttctgactgtgctgactctagcgctgactggaaacatgattagtgccactctgatttatcccatccaacagtacttcggtattatcacaatgaacgttacccttattttaccgatggcgtttgcgagtttctctgagatgttgatatccttggaacgtattcagggattccttcttttggacgagcgttcagacattcaaattacaccaaaagtggtgaatggtgctggaagtaaactgttcaacaattccaagaaggagggaggtctcgaaactggcattgtgctgccaacaaaatactcacctactgaagcgaatattgccagacccatgcaggatgagcctaacatggccgactatcctgtgcaacttaacaaagttaatgcaacatgggcggacctcaatgataacaaagagatgacactcaagaacatatctttacgtgttcgcaaaaataaactatgcgctgttattggacctgtgggatcaggaaagacctctcttcttcagctccttttgcgagagttgccagtgactagcggcaatctcagcatatctggtaccgtatcctacgctagtcaggagccttggctgttccctgcgactgtgcgggagaacattctgtttggtttggaatataatgtcgccaaatataaagaggtttgtaaagtctgctcattactgccagactttaagcagttcccgtacggtgacttgtctctggttggggagcgaggtgtgtcactgtctggtggtcagagggccaggatcaatttagccagagctgtctaccgcgaggctgatatttacttgcttgacgatcctctatcggctgtagacgcaaacgtcggcaggcaactattcgacggctgcatcaaaggatacctcagcggcaagacatgcatcctggtcacccaccaaattcactaccttaaagctgcagactttattgtagtcctaaacgagggttccgtagaaaatatgggctcgtatgatgaactaatgaaaactggaacggaattctcgatgctgctctctgaccaagctagtgaaggctctgacactgacaaaaaagaacggccagcaatgatgcgaggaatatcaaagatgtcagtcaagagtgacgatgaggaaggtgaggagaaggttcaagtattggaggccgaagagagacagtcgggcagtctgaagtgggcgatgtgcttgggaggtacatgaagtcagtcaactcctggtgcatggtggtaatggcattcctcgtgttggtgatcacgcagggtgctgccaccactaccgactactggcttagtttctggactaaccaggtggatggatacatacaaactttacccgaaggagaaagtccaaatcctgaattgaacactcaagtaggtctgttaaccacgggacagtacctcatcgtgcacggcagcgtagtactagccattataatattgacgcaagtcagaatactttccttcgtagtgatgactatgcgagcttcggaaaatcttcataacaccatttacgagaaattgatagtggctgtaatgagatttttcgataccaatccatcgggtcgtgtattgaacagattctcaaaagatatgggtgcaatggatgagctgttgccgcgaagcatgttggagactgttcagatgtacctgtctctagccagtgtccttgtgctgaacgccatagccttaccttggacattgatacccaccacagtgttgatgtttatatttgtattcctattgaagtggtacattaacgctgctcaagctgtgaaacgattggaaggaactacaaagagtccagtgtttggaatgatcaactctactatatctggactctccaccataagaagctccaactctcaggaccgacttctaaactcatttgatgatgcacagaatctccatactagcgctttctacacgtttttgggtggttcaaccgcatttggtctgtacctggacaccctctgtttaatctacctcggaattatcatgtccatcttcattcttggtgatttcggtgagctgataccagtgggtagcgttggtctggccgtcagccagtccatggtgctcaccatgatgttgcagatggccgccaagttcactgccgacttcttgggacagatgacagccgtcgagagggtcctggagtacactaagctacctaccgaggaaaacatggagactggaccgacaacgccaccaaaggactggccaagtgctggagaggtgacgttctcgaacgtgtacctcaagtattctcctgacgacccaccagtactgaaggacttgaactttgcaatcaagagtggatggaaggtcggagtagttggtagaactggcgctggcaagtcctcgttgatatcggctctgttccggctcagcgacattacaggcagcatcaaaattgatggcctcgatactcaaggaattgccaagaagcttttgagatcaaaaatatcaataattccgcaagagccagtgttgttctctgcctcgctgcgttacaatctggacccattcgacaactacaacgatgaagatatttggagagcattggaacaggtggaactaaaggagagtataccagccctcgattacaaagtgtcggaaggcggcaccaacttctcaatgggacaacgtcagctggtgtgcctagcgcgcgccatcctccgctcaaataaaattctcatcatggacgaagctaccgctaacgtcgatcctcagacggatgctttgatccagaaaacaatccgtaaacaatttgcaacgtgcaccgtgctcacgatcgcgcatcgactgaataccattatggattcagatcgagtactagtcatggaccagggagtggccgctgagttcgaccacccctacatcttgctatctaaccccaatagcaagttctcctcaatggtgaaggaaacaggcgacaacatgtcccggatcttgttcgaagtagccaaaacaaaatatgaaagtgattccaaaaccgcttag

SEQ ID NO: 51 - DNA, 4050 bp, Spodoptera frugiperda
atgatggacaaatctaataaaaataccgcggcaaatggcaatggtggtcaacgtgcgggcgaaccaaaggagagagtaagaaagaaaccaaacatattgtcacgaatattcgtttggtggatattccctgtgctcatcactggcaacaagcgagatgttgaagaagacgatttaattgttccgagtaaaaaattcaattctgaaagacaaggagaatattttgaaagatattggttcgaggaggtagcaattgctgagagagaagaccgagatccttcgttatggaaagcgatgcgccgcgcttactggctgcaatacatgccgggagctatcttcgtgctgctcatttctggattaaggacagctcagccattgctgttctctcagctcctgtcctactggtcggtggacagcgagatgtcgcagcaggatgctggtctctatgccctggctatgttggggatcaacttcataaccatgatgtgcacacaccacaacaacttgttcgtcatgcggttcagtatgaaagtcaagatcgccgcctcgtcactcttatttagaaagttgctccgcatgagtcaagtgtcagtgggcgacgtcgccggtggaaagttagtgaacttgctgtccaacgatgtcgcgaggtttgactatgcgttcatgttcctacactacctgtgggtggtgccgctgcaagtcggagtcgtcctgtacttcgtgtacgatgctgctggatgggcgccatatgtcggtctctttggagtcatcattttaatcatgccacttcaagccggtctaacaaaactcacgggtgttgtgaggcggatgacagctaagaggactgacaaaagaattaagcttatgagtgaaattattaacggtatacaggtcatcaaaatgtacgcttgggagaaacccttccaattggtggtgaaagcagctcgtgcgtatgaaatgagtgctcttaggaaatctatcttcatcaggagcatgttcctcgggttcatgttgttcactgagcgaagtgtcatgtttctgactgtgctgactctagcgctgactggaaacatgattagcgccactttgatttatcccatccaacaatacttcggtattatcacaatgaacgttacccttattttaccgatggcgtttgcaagtttctctgagatgttgatatccttggaacgtattcagggattccttcttttggatgagcgttcagacattcaaattacaccaaaagtggtgaatggtgctggaagcaaattgttcaacaactccaagaaggagggaggcctcgagactggcattgtgctgccaacaaaatactcacccaccgaagcgaatattgccagacccatgcaggatgagcctaacatggccgactatcctgtgcaacttaacaaagttaatgcaacatgggcggacctcaatgataacaaagagatgacactcaagaatatatctttacgtgttcgcaaaaataaactatgcgctgttattggacctgtgggatcaggaaagacctctcttcttcagctccttttgagagaattgcctgtaactagtggtaacctcagcatatctggtaccgtatcctacgctagtcaggagccgtggctgttccctgcgaccgtgcgggagaacattctgtttggtttggaatacaatgtcgccaaatataaagaggtttgtaaagtctgctcattactgccagactttaagcagttcccgtacggtgacttgtctctggttggggagcgaggtgtgtcactgtctggtggtcagagggccaggatcaatttggccagagctgtctaccgcgaggctgatatttacttgcttgacgatcctctatcggctgtagacgcaaacgtcggcaggcaactattcgacggctgcatcaaaggatacctcagtggcaagacatgcatcctggtcacccaccaaattcactaccttaaagctgcagactttattgtagtcctaaacgagggttccgtcgaaaatatgggctcctatgatgaactaatgaaaactggaacggaattctcgatgctgctctctgaccaagctagtgaaggctctgacactgacaaaaaagaacggccagcaatgatgcggggaatatcaaagatgtcagtcaagagtgacgatgaggaaggtgaggagaaggttcaagtattggaggccgaagagagacagtcgggcagcctgaagtgggatgtgcttgggaggtacatgaagtcagtcaactcctggtgcatggtggtaatggcattcctcgtgttggtgatcacgcagggtgctgccaccactaccgactactggcttagtttctggactaaccaggtggatggatacatacaaactttacccgaaggagaaagtccaaatcctgagttgaacactcaagtcggtctattaaccacgggacagtacctcattgtccacggcagcgtagtactagccattataatattgacgcaagtcagaatactttccttcgtagtgatgactatgcgagcttcggaaaatcttcataacaccatttacgagaaattgatagtggctgtaatgagatttttcgataccaatccatcgggtcgtgtcttgaacagattctcaaaagatatgggtgcaatggatgagctgttaccgcgaagcatgttggaaacggttcagatgtacctgtctttagccagtgtccttgtgctgaacgccatagccttaccgtggacattgatacccaccactgtgttaatgtttatatttgtattcctattgaagtggtacattaatgccgctcaagctgtgaaacgattggaaggaactactaagagtcctgtgtttggaatgatcaactctactatctcgggactctccaccataagaagttccaattctcaggaccgacttctaaactcatttgatgatgcacagaatctccataccagcgctttctacacatttttgggtggttcaaccgcattcggtctgtacctggacaccctttgtttaatctacctcggaattatcatgtccatcttcattcttggtgatttcggtgagctgataccagttggtagcgtcggtctggccgtcagtcagtccatggtgctgaccatgatgttgcaaatggccgccaagttcactgccgacttcctgggacagatgacagccgtcgagagggtactggaatacaccaagctacctaccgaagaaaacatggagactggaccgacaacgccaccaaagggatggccaagtgctggagaggtgacgttctcaaacgtgtacctcaagtattctcctgacgacccacctgtactgaaggacttgaactttgcaatcaagagtggctggaaggtcggagtagttggcagaactggtgctggcaagtcctcgttaatatcagctctgttccggctcagcgacattacaggcagcatcaaaattgatggcctcgatactcaaggaattgccaagaagcttttgagatcaaaaatatcaataattccgcaagagccagtgttattctctgcctcgctgcgttacaatctggacccattcgacaactacaacgatgaagatatttggagagcattggaacaggtggaactaaaggagagtataccagccctcgattacaaagtgtcggaaggcggcaccaacttctcaatgggacaacgtcagctggtgtgcctggcgcgcgccatcctccgctcaaataaaattctcatcatggacgaagctaccgctaacgtcgatcctcagacggatgctttgatccagaaaacaatccgtaaacaatttgcaacgtgcaccgtgctcacgatcgcgcatcgactgaataccattatggattcagatcgagtactagtcatggaccagggagtggccgcggagttcgaccacccctacatcttgctatctaaccccaatagcaagttctcctcaatggtgaaggaaacaggcgacaacatgtcccggatcttgttcgaagtagccaaaacaaaatatgaaagtgattccaaaaccgcttag

SEQ ID NO: 52 - DNA, 5232 bp, Chrysodeixis includens
atgaagatgaggcgagaggctaagcccgcgggcgcgttcatgaagttccgcctgctgatgtggaagaacttcctgcagcagtggcggcaccggctgcagacggtgacggagctgctgctgcccgtgctcaccatgacgctggtgctggtgctgcgctggcagatggagcccagcatggtcggcaccctcacgtacccgccgataccagcacacacactcaactattctacagccattttagcgggtatgaacttaacacagatgtccatagcatactcaccaagaagtccagtattagatgacgtggtcagaactggaattacaaacttattagttgcgaatgcaaaagatctgcttccaatttttgaaaatatttcaatacctggtttaccagaaatagaacttccatctattcctgaagatttcaactctacactaattgtagagttcttgaagtctcgaataaaaatcgaggcttacaacaatagtcatgatctaagaggactgtacatccgcgaggagtccactcgcgtggttatcgctgggattgagtttgatgacaaactttatgatgcggaaagcttgtcaaacaatttatcatttgcactacggtttcctgaaagacctcgaatgaactctttcttccaacgaggggggcgcacttggcgaacagatatagtgttcccgttatttgaaatgccaggaccaagatatccatggtcatgggaaggcggcagagatccaggctacgtcaacgaaatgtttatcgcgctgcaaaacgctatctctaatgagttgatatccagggctaccggggaggacttgaaaaagttcagggttaatgtccagagattccctcacccgccttacatactcgacatggcggtggatttactgcagttcatgttcccgatgttcatcatgctgagcttcagttacactgccgttaatattgccagagcagtcacagtagaaaaagaattgcaactgaaggaaacgatgaagatcatgggcctacccacgtggctacactggacagcgtggttttgcaagcagtttctctatcttcttattacagcgattttaattatagttcttttaaagatacattggtttactaacgaagagggcttttctgaatacgcagtgtttactaataccccgtggacggtgctgttctttttcatggttttgtacttatcatgcgctatatttttctgttttatgataagcagtttcttttcaaaaggtagtacagcggctttgtgcatgggagtggtctggttcctgtcttacgtccccgccgttctcttggccatggacatcgacatgtctactgcaatgcaagtcttcacgtgccttagcataaattcagcgatgtcttacggtttccaacttctactcgccaaagaagccgttggaggtttgcagtggggcgacttcatgtcgtcaccggcggcggagacgaaccgcttcgtgttcgggcacgtggtcatcatgctggtggtcgactgtgtgctgtacatgctcgtcactctgtacctggagcaggtcatgccagggccctttggcacgcccaaaccctggtatttccccttccaaatgaaattttggtttcctaattatagttcagatgtcggttttattttggaaaacgaagttagtgagtctgaagatataattaaagagaaagacccaatcgaccatacaatcggtgtcaaaatgcatgatctaacaaaaatttacggaaataatgtagcggtcaatcatttatctttgaatatttacaacgatcagattaccgtgctcttggggcacaatggtgcggggaaatctaccaccatatctatgttgacaggaaatttaaaggcaactcgcgggtctatgagcgtggctgggtacgacatgagctcgcaagccgcggccgctcgcgcacacatcggcttgtgtccacaacacaacgtcttgttcaacgaactcaccgtcaaggaacatctccaatttttcgcccgcctcaaaggattcaaaggccaacaattgaaagacgaaattgatactcttatcgctaaattggagttggaagaaaagcgtgattatccttctaaaggtctttctggcggtcagaagcgtcggttatgcgttggtatagctttaagcggggcagctcgtgtcgtgctcctggacgaaccaacctcgggcatggaccctgcatcccgacgagctctctgggaccttttgcaacgggagaagaaaggtcgctcaatgatcctgacgacccactttatggacgaggcagacattctcggcgacagagtggccattatggcgaacggtcgcctgcagtgcgtgggctccccgtacttcctcaagcgtcactatggcgtcgggtacaccctggtcgttgtcaaggatgatgacttcgacttcgaggaatgctctaagctgattcataaatatgtcccaggcagtattatgaaggaagatcgcggttccgaaatcgcgtatagtcttgacaatgattactctcacactttcgaaaatatgttaaatgatcttgaaaagaatattggcacaattaaactgaaaaattatggcttggttgcaactactctggaagatgtatttatgtctgttggcgcggacctggcacctgtacagtcagagtcggacgacactgccaccacaaccaccgactcctcaatggacgatatactcaaacatgaaatcgattcttctttagaacaattggatagagacgagagcagcgtcaaaggtttcagtctattgtaccagcacgttctagcggtgtggatgaagttggccttagtctggatccgatcttggtggctggtgctattgcagtttgccgcccctgtagtcctgataaacgccacgcttggagtcttgcaatacgttatgtcgttcgcgcctatcattacaagcagggttttagatcttacagaaggttatgttctcaccgagaccctgttgagctacaacggttcttcgtcgacgtcgctcggagctctcgcagcacaagcctatgaaacgatgttcaaaacctccggagtcaacagtatggagctcacgttgattggcagtcgaccagtcgaagattattatctagagagggcaaacgacacagtggcaatggctaacctacgtcaccgcctgctgatcggctccactttcgatgaaaactcagctacggcctggttcagtaactttggctaccacgacgtagccacgtcgctagcaactgtctactcagctatactcaaagccaagaactcaaccgcttttatgaacgtttacaatcatcccctggaagccacgtattcggatcaaagtgacttgcagacgatgatagcgatgttgtccatgcagctggcgtctggcatcggcagcagtgtgggcatcgtgagcgctgtgttcatcatgttctatatcaaggagcgtgtatcgggcgccaagttgctgcagaaggcggcgggcgtgcagccggccgtgctgtggggcgcggccgctgtgttcgactggacgtgcttcttactcacctgcatatctatagtcatctcctgtgcggccttccaggtcataggcctgtctacagcttccgagttgggccgcatgtacctgtgtgcgatggtgtacggcgcggcgatgttgccgttcagctacatcatgtcgcacgtgttcagaggaccagccgtcggcttcgttagcttcttcttcatgaatgtcatctttggtatgatgggcccgcaagtggtggaggcgctgtcttcgccgacgctcaccacgcagcacgtggcgcacattatggacaacgtgctgcagttcttcccgctctacagtcttgttacatcagtcaggtatttgaaccagatcggcctccgtgagtacacgtgcctgcaaagctgtgaatacttgcaggcggtgtaccctaacgtcgagtgcacgatggccagcatgtgcgaattctccagtaactgttgcgttcgagataacccgtacttcgactgggaggagcctggcgttctgcggtacttggtcgccatgacaggcacctgcgccgttctatggacgattctgatggtcatcgagtacagactcttccaaaaggtattaagattccgcaagaccccgccgccagtggacgagagctcgttagacgaggacgtggcgcgcgaggctgagagcgcgcgtcacacgcactacgccgaccgcgcgaaccatgccctcctcgccacggacctcgccaagtactacgggaaacatctcgcggtggaccaagtgtccttcagtgtaagcgacggcgaatgtttcggtctgctgggcgtgaacggcgcgggcaagaccacgaccttcaagatgctgatgggcgacgagtccatctccagcggcgaggcctacgtcagcggacactctgtgcggaagaacctgaacagggtgcatgagaatattggttactgtccgcaattcgacgcgttattcggcgagctgactggtcgcgagacgctccgcatgttcgccctgatgcgaggacttcgcctcagcacggccgcgcccgctgtggagacgctctcacacgcactcggcttcttaagacatctcgataagagggtggatcaatattcaggaggcactaagcgaaagctgaacacagcgatagcgttcttaggaaagacgagacttgtgttcgtcgacgaacctaccaccggcgtagaccctgctgctaaacgacatgtatggcgagccacgcggggcgtgcagcgcgcaggccgtggcgtggtgctgacgtcacacagcatggaggagtgcgaagcgctgtgctcacgactcaccatcatggtcaacggacggttccaatgccttggaacaccacaacatctcaagaataaattctctgaaggttttacgttaactatcaaaatgaaaatggaggataatcctgaaacatcgtcgaacagcagcgcaatcagtaaagtggaccttgtcaaggaatacgtcgaagctaatttccagactcctaggataatggaggaataccaaggtctactaacatactacctaccagaccggacaatggcgtggtcgcgaatgttcggtatcatggagcgagcgaaacgagacttagaaatcgaggattacagcatatcacagacgacattagaacagatattcctacaattcacaaagtaccagcgacaagaaggcgatgaatcatag

SEQ ID NO: 53 - DNA, 5250 bp, Ostrinia nubilalis
atgaatcggaaaagagaaagcggaagggcggccggatcgtggatgaaattccgtttgctaatgtggaagaattttctgcaacaatggaggcatcctattcaaactatcgtagaggtgttgttgccagttatcacgatgtctctagtgctactgcttcggtggcagattgaacctaccgcagaagatgcgataaacttttcgccattacctgcacaatcactgaataattctatacaaatatttgctggtctcaacgtaactaatttctccattgcatactctccaagaagtgaagccttggaggatgtcttacgtagttccatggcaaacttactgctaaacaatgcgttcgatctaatcagaattatcactgatctgtggcctgctgaaccgccattcccactgccagcgaatataacgtggcctgaaaccccgccagtcacactgcctccagatttagactggcctgatttagagggtgtaaacaaaactctgatttacgagtttctcagaaccttaatacgagttcaaccatacaattctagtgttgatctcagaactatttatgcttacgaagagagaactaagcaagtaatagcagctgtggaatttgatgactctctttttggtgctacggatttgcctggaagtatatcgtattccttaaggtttccggagaggcctcgccttaatgcattatttggtcgaggcggccgatcttggagaacagacgaattgtttcctgcatttgagttacctggaccaagatcccgttcttccgatggaggctccaatcctggctacgtcagggaaatgtttattgcgcttcagcaagtaatatcaacgcaactaataacaagaattactggggagcctatggagtcattctcagtcaatattcagagatatccacaccctgcatatgtcgatgatatggcagtagaggcactccagtttctatttcccatgttcattatgctgacctttagctacacagccgtgaatatcaccagagccatcacagttgagaaggaacttcaacttaaggaaacattgaaaattatgggcttacccacatggatacattggactgcatggttttgcaaacagttcctctttttattggtagcagctgttcttattatgattcttctaaaggttaattggtttacgaacgaagatgggttcagcgattacgccgtatttacaaatacaccatggagtgtcttgctattctatttaacactctacttggcatgcgtgatattcttttgtttcatgctcagtggtatattttcgaaaggtagtacagcagcgctatttgccggtgtggtgtggttcctcacctacgtcccagcgtttatcctgtccattgacattgctatgtcagtccctatgcaaatatttacatgtctcagtatcaactctgcaatgtcttacggattccagctgcttctgggtagagagagcacaggcggtatgcaatggggcgagttcatgtcggcgcccgtgacggagaccgaccggctgctgttcgggcacgtggtaatcatgctggtggtggactcggtgctgtacatgctgatcgcgctgtacctggagcaggtgctgcccggcccctacggcacgcccaggccctggtacttcttattccagaaacaattttgggggtgcggcactaaatctgcatcagattcagtattactaaatgttgctgaaactcctgatgtaataaaggagaacgatccggtgggtcacccagttggagttaaaatgaacaatctgacaaaagtattcggcaagaatactgcagtaaataatttgagtttaaatatatacgacgaccaaattacagttttgctcggccataatggagcaggaaaatctacaactatatcgatgttgacaggtaatttggaggcaacatatgggacagtgtgggtggccggctatgacatgacttggaacaccagtgatgctcgctcacatataggactatgccctcaacataacgtcctgttcaatgagctcaccgtcagggaacatttagaattctttgccagactgaaaggattccaaggcgaagaattgaacaatgaaatagacactcttatcgagaaactagagttgacagagaagcgtgactaccagtccaaaggcttgtccggcggacagaagcggaggctgtgcgttggcgtggcactgtgtggcgacgcgcgagtggtgctccttgacgagcctacgtcgggcatggacccctcctcgcgccgcgctctctgggacctattgcagaaggaaaaaaaaggtcgttccatgatattgacaacgcacttcatggacgaagctgacatcctgggggaccggatcgctattatggcgagcgggcagttgcaatgcgtcggctcgccatacttcctcaagcgacactacggcgtcgggtacactctggtcattgtcaaggatgttgacttccagttggaagcctgcacggagattttaagcaaatatattccaggaactactgttaaggaagataggggaacggaagttacatacaatttgactaacggtcgatctcaaatattcgaaacaatgttattggacctagaaaaaaatatgcaacaaataaaattcaaaaactatggattagttgccacgaccttagaagatgtgtttatgtcagttggatctgatgtatcatccacacagtcagagtcagatgaggtggaaactgcaactgagtcatcgtattacgactttgattcatcttcaatggataacttaacacaagaacagtcgatcagtggttttcgtttgttggtgcaacatgttttggccgtctggctgaagctgtctctggtctggatccggtcctggggcctgattctgctgcagattttggtaccggtgctacaaatgaccgcaacacttggagttatggaatacattttcagtttgataccaactatacagcgcagggcgctatcgtttgccgtaggttattcgcaaacggagagccttttgagtttcatcggcaattccacatcatcactgggggccctagcgactgcagcatacgagacgatgatcaactcgagcgttgtcgacaccatgtcgttgaccatggtcaatgaaccgattgatgaatattatatggaaagggcggaacaaggaggagtgggaccgctgcgccacacggttttggcgggtgccactttcacagatgattcggtaaccgcatggttcagcaacttcggctaccacgacattgccacttcgttagccgccgttcacaccgcgcttatcaaagctaaaaacgcttcgtatgaaatcaacgtgttcaaccatccacttgaagtcaactatgctgatcaaagtgaccttcaaatgcgggtgacgatgctagccatgcaactggcttccggcatcgggagcagtttgggtattgccagtgcagttttcgtcatgttttatattaaggagcgcgtgtctcgagcgaaactgctgcagaaggcggccggcatccagcctgcagttctatggggcagcgcggctgtgttcgactggctgtggttccttgtggtctgcgtcactatcgtcatcatttgtgccgcttttgacgtcatgggcctctcatccgtcgacgaactcggtcgcctatacttgtgcctgatggtgtacggcgctgcgatggtgcctctgaactacctgtcttccctcctgttccaaggcccggcacttggcttcgttgtcatattcttcataaatgtactcttcggaaatatgggggctcagatcgtggacgcactgtcatcgccgcagctaaataccgcagaggcggcgaggatcctggactatatactgcagttctttccactctacagtctcgtaacgtctgtcagactattgaatcagttcggcatgttagagagctcgtgcctacaaagctgtggatacttacagaacattatgaacataccagagtgcaatatgactgttatgtgcgatctctatgaagaatgctgtattcctgcagacccatactgggcctgggacggtggcattatgcgatatgtaactgtcatgctgatcacctgtcttgtattgtggggaatactcatgattatagagtacgacgttattaagaagataatcagacgagagaagaaaccaccacaagttgacgaaagcacactagacgaggatgtattggacgaagagaagcacgtcgcgcgcatcggctccgacctctctcagcacagcctcgtggcgcgcgggctctccaagtactacggcaagcacctggccgtcaatcaagtgtccttcagcgtaagcgactctgaatgcttcggtctgctgggggtgaacggagccggcaagaccaccacgttcaagatgctaatgggcgacgagaccgtctccagcggagacgcgttcgtcagtggccactctgtcaggaaggacatcacacgtgttcatgaaaatatcggatactgcccgcagttcgacgccgtattcggcgaactgacgggccgtgagacgttacttttgttctcgctgctccgcgggctcagcgccagccgcgctgacgctcgcacgcacgcgctggcgcatgcgctcggcttcaccaagcacttgaacaaacgggtaaaccagtattcagggggcaacaaacgcaaattgagcacagcggtagccttactgggccgcactcggttggtgttcgtcgacgaacccaccactggcgttgaccctgcggctaaacgacaggtatggcgtgctatccgaggcgcccagcgttcaggcagaggcgtggtgctgacgtcacatagcatggaggagtgcgaggcgctatgctcgcgcctcaccatcatggtcaacggccgcttccagtgccttggcacccctcaacacctgaaaaacaagttttctgaaggttttactttaactattaaaatgagacaagaagaggagcaagcatcaactagttcatgcattgttcagagacctgtagatacggtcaaacaattcgtcgaatccaacttcactaacccaaaacttatggaagagtatcaaggtttgctgacatactacttgcccgaccgcagcatcgcatggtcaagaatgtttggaatcatggagcaagccaagagagacctccaggtggaggactacagcatttcccaaaccactttagaacagatcttcctacaatttaccaaatatcaacaagaggctgcaattcaataa

SEQ ID NO: 54 - DNA, 5250 bp, Ostrinia nubilalis
atgaatcggaaaagaggaagcggaagggcggccggatcgtggatgaaattccgtttgctaatgtggaagaattttctgcaacaatggaggcatcctattcaaactatcgtagaggtgttgttgccagttatcacgatgtctctagtgctactgcttcggtggcagattgaacctaccgcagaagatgcgataaacttttcgccattacctgcacaatcactgaataattctatacaaatatttgctggtctcaacgtaactaatttgtccattgcatactctccaagaagtgaagccttggaggatgtcttacgtagttccatggcaaacttactgctaaacaatgcgttcgatctaatcagaattatcactgatctgtggcctgctgaaccgccattcccactgccagcgaatataacgtggcctgaaaccccgccagtcacactgcctccagatttagactggcctgatttagagggtgtaaacaaaactctgatttacgagtttctcagaaccttaatacgagttcaaccatacaattctagtgttgatctcagaactatttatgcttacgaagagagaactaagcaagtaatagcagctgtggaatttgatgactctctttttgatgctacggatttgcctggaagtatatcgtattccttaaggtttccggagaggcctcgccttaatgcattatttggtcgaggcggccgatcttggagaacagacgaattgtttcctgcatttgaattacctggaccaagatcccgttcttctgatggaggctccaatcctggctacgtcagggaaatgtttattgcgcttcagcaagtaatatcaacgcaactaataacaagaattactggggagcctatggagtcattctcagtcaatattcagagatatccacaccctgcatatgtcgatgatatggcagtagaggcactccagtttctatttcccatgttcattatgctgacctttagctacacagccgtgaatatcaccagagccatcacagttgagaaggaacttcaacttaaggaaacattgaaaattatgggcttacccacatggatacattggactgcatggttttgcaaacagttcctctttttattggtagcagctgttcttattatgattcttctaaaggttaattggtttacgaacgaagatgggttcagcgattacgccatatttacaaatacaccatggagtgtcttgctattctatttaacactctacttggcatgcgtgatattcttttgtttcatgctcagtggtatattttcgaaaggtagtacagcagcgctatttgccggtgtggtgtggttcctcacctacgtcccagcgtttatcctgtccattgacattgctatgtcagtccctatgcaaatatttacatgtctcagtatcaactctgcaatgtcttacggattccagctgcttctgggtagagagagcacaggcggtatgcaatggggcgagttcatgtcggcgcccgtgacggagaccgaccggctgctgttcgggcacgtggttatcatgctggtggtggactcggtgctgtacatgctgatcgcgctgtacctggagcaggtgctgcccggcccctacggcacgcccaggccctggtacttcttattccagaaacaattttgggggtgcggcactaaatctgcatcagattcagtattactaaatgttcctgaaactcctgatgtaataaaggagaacgatccggtgggtcacccagttggagttaaaatgaacaatctgacaaaagtattcggcaagaatactgcagtaaataatttgagtttaaatatatacgacgaccaaattacagttttgctcggccataatggagcaggaaaatctacaactatatcgatgttgacaggtaatttggaggcaacatatgggacagtgtgggtggccggctatgacatgacctggaacaccagtgatgctcgctcacatataggactatgccctcaacataacgtcctgttcaatgagctcaccgtcagggaacatttagaattctttgccagactgaaaggattccaaggcgaagaattgaacaatgaaatagacactcttatcgagaaactagagttgacagagaagcgtgactaccagtccaaaggcttgtccggcggacagaagcggaggctgtgcgttggcgtggcactgtgtggcgacgcgcgagtggtgctccttgacgagcctacgtcgggcatggacccctcctcgcgccgcgctctctgggacctattgcagaaggaaaaaaaaggtcgttccatgatattgacaacgcacttcatggacgaagctgacatcctgggggaccggatcgctattatggcgagcgggcagttgcaatgcgtcggctcgccatacttcctcaagcgacactacggcgtcgggtacactctggtcattgtcaaggatgttgacttccagttggaagcctgcacggagattttaagcaaatatattccaggaactactgttaaggaagataggggaacggaagttacatacaatttgactaacggtcgatctcaaatattcgaaacaatgttattggacctagaaacaaatatgcaacgaataaaattcaaaaactatggattagtagcaacgaccttagaggatgtgtttatgtcagttggatctgatgtatcatccacacagtcagagtcagatgaggtggaaactgcaactgagtcatcgtattacgactttgattcatcttcaatggataacttaacacaagaacagtcgatcagtggttttcgtttgttggtgcaacatgttttggccgtctggctgaagctgtctctggtctggatccggtcctggggcctgattctgttgcagattttggtaccggtgctacaaatgaccgcaacacttggagttatggaatacattttcagtttgataccaactatacagcgcagggcgctatcgtttgccgtaggttactcgcaaacggagagccttttgagtttcatcggcaattccacatcatcgctgggggcgctagcgactgcagcatacgagatgatgatcaactcgagcgtcgtcgacaccatgtcgattaccatggtcaatgaaccgattgatgaatattatatggaaagggcggaacaaggaggagtaggaccactgcgccacacggttttgtcgggtgccactttcacagatgattcggtaaccgcatggttcagcaacttcggctaccacgacattgccacttcgttagccgccgttcacaccgcgcttatcaaagctaaaaacgcttcgtatgaaatcaacgtgttcaaccatccactagaagtcaactatgctgatcaaagtgaccttcaaatgcgggtgacgatgctagccatgcaactggcttccggcatcgggagcagtttgggtattgccagtgcagttttcgtcatgttttatattaaggagcgcgtgtctcgagcgaaactgctgcaaaaggcggccggcatccagcctgcagttctatggggcagcgcagctgtgttcgactggctgtggttccttgtggtttgcgtcaccatcgtcatcatttgtgccgcttttgacgtcatgggcctctcatccgtcgacgaactcggtcgcctatacttgtgcctgatggtgtacggcgctgcgatggtgcctctgaactacctgtcttccctcctgttccaaggcccggcacttggcttcgttgtcatattcttcataaatgtactcttcggacttatgggggctcagatcgtggacgcactgtcatcgccgcagctaaataccgcagaggcggcgaggatcctggactatatactgcagttctttccactctacagtctcgtaacgtctgtcagactattgaatcagttcggcatgttagagagctcgtgcctacaaagctgtggatacttacagaacattatgaacataccagagtgcaatatgactgttatgtgcgatctctatgaagaatgctgtattcctgcagacccatactgggcctgggacggtggcattatgcgatatgtaactgtcatgctgatcacctgtcttgtattgtggggaatactcatgattatagagtacgacgttattaagaagataatcagacgagagaagaaaccaccacaagttgacgaaagcacactagacgaggatgtattggacgaagagaagcacgtcgcgcgcatcggctccgacctctctcagcacagcctcgtggcgcgcgggctctccaagtactacggcaagcacctggccgtcaatcaagtgtccttcagcgtaagcgactctgaatgcttcggtctgctgggggtgaacggagccggcaagaccaccacgttcaagatgctaatgggcgacgagaccgtctccagcggagacgcgttcgtcagtggccactctgtcaggaaggacatcacacgtgttcatgaaaatatcggatactgcccgcagttcgacgccgtattcggcgaactgacgggccgtgagacgttacttttgttctcgctgctccgcgggctcagcgccagccgcgcggacgctcgcacgcacgcgctggcgcatgcgctcggcttcaccaagcacttggacaaacgggtaaaccagtattcagggggcaacaaacgcaaattgagcacagcggtagccttactgggccgcactcggttggtgttcgtcgacgaacccaccactggcgtcgaccctgcggctaaacgacaggtatggcgtgctatccgaggcgcccagcgttcaggcagaggcgtggtgctgacgtcacatagcatggaggagtgcgaggcgctatgctcgcgcctcaccatcatggtcaacggccgcttccagtgccttggcacccctcaacacctgaaaaacaagttttctgaaggtttcactttaactattaaaatgagacaagaagaggaacaagcatcaactagttcatgcattgttcagagacctgtagatacggtcaaacaattcgtcgaatccaacttcactaacccaaaacttatggaagagtatcaaggtttgctgacatactacttgcccgaccgcagcatcgcatggtcaagaatgtttggaatcatggagcaagccaagagagacctccaagtggaggactacagcatttcccaaaccactttagaacagatcttcctacaatttaccaaatatcaacaagaggctgcaattcaataa

SEQ ID NO: 55 - DNA, 3987 bp, Ostrinia nubilalis
atgttgcccatatactacaatgggacgaaaagggacttagaagagtacgatttagtgccagcgaaacgacaatacgactcgaaacgtgttggggatgtgttagaaagatattggctcaatgaagaagctgcagccaaagccgctggaaaaaagccatcgttgctaaaaactttcgccaaagcttttgggctaagtttcatatctgctgggataatgcagtttttaagtgttggtataaggaccttcacaccgctgctgttcgcccaactgctgcagtactggtcggtgggttccaccatgtcgaaggagacagccgcgatgtacgccgggggcatgatcctggccaactgggcgtcggctttcctcaaccaccacgggaacctggctgcacagcaattcggaatgaaactccgaatctctgctagctctcttatgtttagaaagataatgcgaatggacaacagttctctgggcgatacgacagctggtaaagttgtgaacattctttcgaacgacatgcagcggttcgacttggctctactgttcctgcactacatctggatcatcccgatacagctggccgtggtgtgctacctggggtaccttcaggccgggtatgcagctctggttgggctggcatcgctcgttattatagcgttgcccatacaaggttatgttggtcaaaaaaccggtaaagtcagattccggactgctgaaaaaacagatgagcggattaaagttatgagtgaagttatcagtggtatacaggtgatcaaaatgtacgcttgggagataccattccaaaaagtggtgagcgagaaacgtgccaatgaactgaaggagatcagagtggcttcgtacttgaggatcgtcttccttggcttcatgctgttcacggagcgatcggccctcttcatcacaatcctcgtcttcatcttgttcggcaacacaatgtcagctaatgttatataccctctacagcagttcatgagtgcagcccaaatcaatatcactctaatcctacccttggtgctcgcattcacagctgaacttttcgtcaccataggaagaatccaagattttctacaagcagaggaccggccggatttggcaaaaaatccacaatctgctgcgccaatgcaaaatttgttcaacaaattgtccgctgaaggggcactagaaaagggcgacgaccatgtcaggcccctttcgtatcatagaaagtctgaagctaagatcactgaaacgcctcctgtgaatgtgaagccccgcaaaagcgtgtcgcttcctggtgacatcgctgtagaacttcgcaacgtgtcagccagctggacgaacgaccccactatgtcggcgcttagcaacgtgtcgttaaggctgcgcaggggcaagctctgcgccgttataggagccgttggttctggaaagtcatcaatacttcaaatgctgctgaaggagctgcctccatactcgggcacggtgtcggtgaatgggaccgtgtcgtatgcgtcgcaggaggcgtggctgttccctagcactgtgcgagagaacatcctctttggactggctttcgaccctgagaagtacaaaagagtgtgcagggcgtgctgcctagagaaggatttcaaacagtttccctacggcgaccagaccctggtaggggagaggggggtgtccctctcgggggggcagcgcgccagaatcaatttggcccgctccgtctatagagagtctgacatctacctattggacgacccgctgtcggcggtggacgcgaacgtcggtcgcctgctgttcgagggctgcatcaacggctacctccgcggacgcacgcgcatcctcgtcacccaccagatacacttcctcaaggctgccgactatatcgtggtgttgaatgagggccaagtggaaaacatgggcactttcgacgagctggttgagagtggcaaggagttcgcgacgctgctcgcctctttacaagaagggaaagataaggacgcggacagtgttggatcaggtgtcagcattgaagacaaagagaagcgcgatttcaagaggatgatatcgactgcgtcgacaaacgaaaacgatgatattgaagagtttaaggctcaaactcaggaggccgaggaaaggcagtcgggcaacttaaagtggtccgtagtgtcagcgtacttcagttccggaggcaatatctgtttcattgctttcacggtgaccatgatcctgctggcggcggttgcagctggagctaccgactattggatcagtttctggtccaacaacatggctcgttacgaagaatcattggaaggtggcgtaccagagtctggacttgacgtgcaagtgggtctgttcaccaccgggcagtacctgatcatccacggctgcctggtcatcacccttgttctgctgacgcatctgagaattttcccgttcgtcgccctcgttgttactgcttcaaagaatctccacgactttatgttctctacgatgataaagggaatcatgagattcttcgataccagctcttcaggtcgaattctcaacagatttacaaaagacatgggagcgctggatgaaattctgcctcgaacattactggacgtggtccaaatctacagtaccctgttagtcatcctgatactgaacgccattgctctgtactggacgctgataccgtcgtttgttctgctcatttgctttatgttcatggttagaatttacatgaagactgctcaaagtattaagagattggagggaataacaaaaagtcctgtattcggcatggtgacttcttcactcaatggaatagctactatcagatcggctggtgctgagaaaaggcttatcgatgactttgataatcaccaggatttgcatacagcctcgtggaacgggtatctttgcggaggcagttctttcggcctttacctcgacaccgtttgtcttatctacctcactacagtcattttcatatttatctatattgattttggagacctaatcgccgtgggcagcgtgggcatagcggtgacacagaccaacgcgttaacggccatgctgcagcacggtgccaggatgttggtggagttcatagctcagctcactagtgtcgagcgagtgcttgattacacgcgaatcgagaccgagagcaacctgtttgaaggacagatcgagtcgattccaacgtggccctcggagggaaggatcgtttttgacaacgtcaatatgcggtactcgcctaccgaggaacctgtcctcaaggatttgaacataaccgtcgaaagtgggtggaaggtgggcatcgttggtagaacaggcgctgggaaatcgtctttaatttcagctctgttcagatttgcgtacctcgatggaaaagtgactatcgacggtgtggacacttctctagtcgccaagcaggagctgcgttctaaaatctcaattatcccacaagagccagttttgttctcagcaacgattagatacaacttagatccgttcaacctctatagtgacgctcagatttggcaggcacttgaacaggtggacatgaaatctgctgtgccatcattggacttcaaagtgacggaaggtggatcgaacttctccgttgggcagcgacagctcatgtgcttggctcgggctgtgctcaggtccaacaaaatattgattatggacgaagccaccgctaatgttgacccacagacggacaactatatccagcaaactatcaaggagcatttcgcctcgtgcacggtgctcaccattgctcatcgtctcaacaccatcatggagtcggaccgcgttctggtcatgagcttcggccgcgtcctcgagttcgagcatccctacatcctcctcagtgaccctaacagccacttcagctccatggtcaaggagactggagagaagaacgcggccctacttttccaagtagcaaaggacgcctatttccaaagcaatctgaaagaaaacgccagatga

SEQ ID NO: 56 - DNA, 5289 bp, Helicoverpa zea
gtgacaatttacgcacattatatcgatacacaaaataaacaggaggaggacgataccgagatgagattagaaacgaggcacgctagtgccgccaccaagttccgcctgctcatgtggaagaactttctgcagcaatggagacatcggctacaaactgtcgtagagctactattgccagtcgtgacaatggcgctggtgctcatccttcggtggcagataccgccttatcaaatcgatacactcacttaccccgcgttgccagcgcacacactcaactactctaccaatatcctttttgccatgaatatggaagaattatcaattgcatactccccggcaagtccagtgttagatgatgtaatgagaactgctgttattaatttactaacagccaatatgaaagatctgattcctatttttattgataacttaccaccggggatagccaatataacatttccaccagatatgaacttaaatacgtcggccattgaggagttcgtgaagtcacgaatacgagtcgtaccttataacagcagttatgaaataagagggatctacgttgacgaagaaactacacgcagcattatcgctgccgtcgagtttgacgataaactatatggagcagaacagttgtcaaataatttatcttattcgctacgttttcctgagagaccccgtctcaattcgtttttccaaactggagggcgcacctggagatctgacggagtattcccggttttcgaagtgcctgggcctagatttcctcactcgtgggaaggtggtaatgacccaggttacgttaacgaaatgttcgtggcacttcaacaagttatttccatggagctggtatcaagggcaaccgggttggacttgaagtcatttagggtgaacatacagaggtacccgcacccgccgtaccttcacgaccagtcagtggatctgctgcaatttatgttccccctgttcatcatgttgagcttcagctacactgctgtcaacattgcacgggcggtcacagttgagaaggaattgcaattaaaggaaactatgaaaattatgggcctccccacatggttgcactggacagcatggtttgttaaacagtttatctacctatcaatcacagctgttctgctagttgtgttgctaaaggtaaattggtttactaacgacgatggcttcagcgaatatgctgtatttactaatacaccttggacggttttgctattcttcttgatactgtatttatcttgcgcgatatttttttctttcatggtaagcagtatattttcaaaaggtagtacggccgcgttgtttatggcggtggcatggttcctcacttacatccctgctttcctcctggccatggatatcaatatgtcgactgcggtgcaggtcatcacatgcttcagtattaactctgcgatgtcctatggtttccaactaatgctcgctaaggaaagcactggagggctgcagtggggcgacttcatgacgtcaccagggacggacaccacgcgcttcgtgttcggccacgtggtcatcatgctggtagtggactgcctcatctacatgctgatcaccctctaccttgaacaagtgctaccaggccccttcgggactcccaaaccttggtacttccccttccagttgcagttctggttcccaaattataaatcgaaagatgctggattaattttcgaaaatgataatagtgaattcgatgatattataaaagaaaaggatcccacagaccacgaagttggtgttaaaatgcaaaatttaacaaaaatctttgggaataacatagctgttaacaatttatctttgaatatctatgacgaccaaatcacagttttacttggtcataatggtgctggcaaatcaactacaatatctatgttaacaggaaatttaaaggtaactcgcgggacagtgaacgttgccggatatgatatgacttctcaaagctccgcagcccgttcccacattggattgtgtcctcagcacaatatactgtttaacgaactcacggtcaaagaacatttggaattctttgctagactaaaaggatttaaaggcaaagaactgtatgaagagatagactcacttattgaaaaattggaactacaggagaagcgtgactacccctcaaaaggtctgtcaggaggtcagaagcgtcgtctttgtgttggtattgctctgagtggggcggcacgagtggtcttactcgacgaacctacgtctggcatggatccttcatctcgtcgagcactgtgggaactcttacagaaggaaaagaaaggtcgctcgatgatcctgacgactcattttatggacgaagcagatattctcggcgacagagtggctataatggcaaacggtagactgcaatgcgtgggctctccgtatttcctcaaacgtcattatggcgtcgggtataccctggtgatcgttaaggacacagacttcgactttgtgaaatgctccgtacttatcaatagctatattcctggtactattgttaaagaagatcgaggaacggaaatcacttataatttggtaaacgattactcacacgtttttgaagaaatgttgaatgatttggaaagaaatattgataacatcaaatttaaaaactatggtttagttgctactacattagaagatgtctttatgtccgttggtgcagacttaagtccaattaattccgaatctgacgatgctattactactactactgactcgactatcgatgatatattaaaacaagaaatcgattcatctttggaagaactggataaggacgagagtaacgtgacgggcctccgcttgttcggtcagcaagtgctggctgtatggatgaagcagtggctggtgctgatccgctcgccatgggtcatggtactgcagtttttggcgccagtggtactcatcaactccacgctaggagttctgcgttacgtcatgtctttatcaccgaccattagaactaggtggttgtcgttggaagaagggtatacggaaagcgaaactctgctcagcttcaacggtagtgtagcgtcatcagtgggtgccctagccgcgcaagcataccaaagcctgttcgccaattctggtgttatggacatggaaatcaacgctatcggaagccagccaatagaagaatattatctaaatagaacaagtgatcccgttgtgatgggttcgctgcggcaccgcttgctgataggctccacatttgacgacaactctgctaccgcctggttcagtaactttggctaccacgatgttgctacatcgcttgcggcaatccactcagctattctcagatctaaaaactctgatgcagtactcaatgtatataatcatccgttggaagcttcgtatatagatcagagtgacgtgcagactatgatagctatgttgtccatgcagttgtcctctggcatcggcagtagtgtgagcattgttagtgcggttttcatcatgttttatatcaaggaacgtatgtcgggggcaaaacttctacaaaatgcagcaggcgtggcgccttctgtgctgtggggcggcgcagcgatcttcaattggttttggttcctcatcacttgtgtttccatcgtcatctcgtgcgtcgcttttgatgtcatcgggttatcgaacgtgcatgaattaggtcgaatgtttttgtgcgtcatggtatacggtgcggcgatgttgccattagtgtaccttttgtcgcttaagttcaagggaccagctgtcggcttcgtgggcttctatttcctcaacgtgcttttcggtatgatgggtgcgcaggtggtggaggcactatcctctcctatgctggacacagagcaagccgcccacatccttgactacttactgcagttctacccgctttacagtcttgtcacttctatcaggtttttaaatcaagtcggcctacgggagtatacttgcttacaaggctgtgaatacttgcaggcagtatacccgaatctagagtgtagcatggcaagcatgtgcgaattccacagtaactgctgcgttcgtgaaaacccatacttcgattgggaggaaccaggcgtcctgaggtacttgctcagtatgtgcttctcctgcctaatcttctggttgctgcttatgaccattgaatacagagtggtgcaaaaggtgttcacattcaagaagactcctcctccaatagacgagagcacgttagacgaggacgtgatgacagaggcgaggcgcgcgcgccaggtgccgccgacacgccgcagcgaccacgcgcttctcgctcacgacctctccaagtactacgggaaacatctcgccgtagaccaagtctcgtttagtgtgaacgacggcgaatgcttcggtctattgggtgtgaatggtgccggaaaaacgaccaccttcaagatgctgatgggtgatgagtccatttcaagcggcgaggcgtatgtctccgggcactcggtgcagaggaatctcgatagagtacacgagaatattggatattgtccgcaatttgacgcattatttggtgagctgacgggtcgccagacactacacatgtttgcgttgatgcgcggcttgcgtttacgcactgcagcaccttcggctgaaacactcgcacatgcgcttggcttcttcaaacatcttgataaaagggtgcatcagtattcaggcggcacgaaacgcaagcttaacacggcgatagcattcatgggacgaacacggcttgtgtttgttgatgagcctaccactggagttgatcccgccgctaaacgccacgtatggcgcgctacccgcggcgtgcagcgagcaggtcgcggcgtggtgctgacgtcacatagtatggaggagtgcgaggcgttgtgttcgcgactgaccatcatggtcaacggtcgcttccagtgtctgggaacgccacaacatctcaagaacaaattttctcaaggctttactttaatcattaaaatgaaaactgacgacagtgacagcgacacgcagtcagtaaacagcactaccagcgtagtagatagtgtcaaactatacgtctctgggaactttgaaagtccaaagataatggaagagtatcatggtcttctaacttactacttgcctgaccgtagcatggcatggtcacgaatgtttggtatcatggagcgcgccaaacagatcttacaaattgaggactacagcatatcgcagactaccctcgaacaaatattcttgcagttcaccaaataccaaagagaagaaggaacgacgttataa

SEQ ID NO: 57 - DNA, 5229 bp, Helicoverpa zea
atgagattagaaacgaggcacgctagtgccgccaccaagttccgcctgctcatgtggaagaactttctgcagcaatggagacatcggctacaaactgtcgtagagctactattgccagtcgtgacaatggcgctggtgctcatccttcggtggcagataccgccttatcaaatcgatacactcacttaccccgcgttgccagcgcacacactcaactactctaccaatatcctttttgccatgaatatggaagaattatcaattgcatactccccggcaagtccagtgttagatgatgtaatgagaactgctgttattaatttactaacagccaatatgaaagatctgattcctatttttattgataacttaccaccggggatagccaatataacatttccaccagatatgaacttaaatacgtcggccattgaggagttcgtgaagtcacgaatacgagtcgtaccttataacagcagttatgaaataagagggatctacgttgacgaagaaactacacgcagcattatcgctgccgtcgagtttgacgataaactatatggagcagaacagttgtcaaataatttatcttattcgctacgttttcctgagagaccccgtctcaattcgtttttccaaactggagggcgcacctggagatctgacggagtattcccggttttcgaagtgcctgggcctagatttcctcactcgtgggaaggtggtaatgacccaggttacgttaacgaaatgttcgtggcacttcaacaagttatttccatggagctggtatcaagggcaaccgggttggacttgaagtcatttagggtgaacatacagaggtacccgcacccgccgtaccttcacgaccagtcagtggatctgctgcaatttatgttccccctgttcatcatgttgagcttcagctacactgctgtcaacattgcacgggcggtcacagttgagaaggaattgcaattaaaggaaactatgaaaattatgggcctccccacatggttgcactggacagcatggtttgttaaacagtttatctacctatcaatcacagctgttctgctagttgtgttgctaaaggtaaattggtttactaacgacgatggcttcagcgaatatgctgtatttactaatacaccttggacggttttgctattcttcttgatactgtatttatcttgcgcgatatttttttctttcatggtaagcagtatattttcaaaaggtagtacggccgcgttgtttatggcggtggcatggttcctcacttacatccctgctttcctcctggccatggatatcaatatgtcgactgcggtgcaggtcatcacatgcttcagtattaactctgcgatgtcctatggtttccaactaatgctcgctaaggaaagcactggagggctgcagtggggcgacttcatgacgtcaccagggacggacaccacgcgcttcgtgttcggccacgtggtcatcatgctggtagtggactgcctcatctacatgctgatcaccctctaccttgaacaagtgctaccaggccccttcgggactcccaaaccttggtacttccccttccagttgcagttctggttcccaaattataaatcgaaagatgctggattaattttcgaaaatgataatagtgaattcgatgatattataaaagaaaaggatcccacagaccacgaagttggtgttaaaatgcaaaatttaacaaaaatctttgggaataacatagctgttaacaatttatctttgaatatctatgacgaccaaatcacagttttacttggtcataatggtgctggcaaatcaactacaatatctatgttaacaggaaatttaaaggtaactcgcgggacagtgaacgttgccggatatgatatgacttctcaaagctccgcagcccgttcccacattggattgtgtcctcagcacaatatactgtttaacgaactcacggtcaaagaacatttggaattctttgctagactaaaaggatttaaaggcaaagaactgtatgaagagatagactcacttattgaaaaattggaactacaggagaagcgtgactacccctcaaaaggtctgtcaggaggtcagaagcgtcgtctttgtgttggtattgctctgagtggggcggcacgagtggtcttactcgacgaacctacgtctggcatggatccttcatctcgtcgagcactgtgggaactcttacagaaggaaaagaaaggtcgctcgatgatcctgacgactcattttatggacgaagcagatattctcggcgacagagtggctataatggcaaacggtagactgcaatgcgtgggctctccgtatttcctcaaacgtcattatggcgtcgggtataccctggtgatcgttaaggacacagacttcgactttgtgaaatgctccgtacttatcaatagctatattcctggtactattgttaaagaagatcgaggaacggaaatcacttataatttggtaaacgattactcacacgtttttgaagaaatgttgaatgatttggaaagaaatattgataacatcaaatttaaaaactatggtttagttgctactacattagaagatgtctttatgtccgttggtgcagacttaagtccaattaattccgaatctgacgatgctattactactactactgactcgactatcgatgatatattaaaacaagaaatcgattcatctttggaagaactggataaggacgagagtaacgtgacgggcctccgcttgttcggtcagcaagtgctggctgtatggatgaagcagtggctggtgctgatccgctcgccatgggtcatggtactgcagtttttggcgccagtggtactcatcaactccacgctaggagttctgcgttacgtcatgtctttatcaccgaccattagaactaggtggttgtcgttggaagaagggtatacggaaagcgaaactctgctcagcttcaacggtagtgtagcgtcatcagtgggtgccctagccgcgcaagcataccaaagcctgttcgccaattctggtgttatggacatggaaatcaacgctatcggaagccagccaatagaagaatattatctaaatagaacaagtgatcccgttgtgatgggttcgctgcggcaccgcttgctgataggctccacatttgacgacaactctgctaccgcctggttcagtaactttggctaccacgatgttgctacatcgcttgcggcaatccactcagctattctcagatctaaaaactctgatgcagtactcaatgtatataatcatccgttggaagcttcgtatatagatcagagtgacgtgcagactatgatagctatgttgtccatgcagttgtcctctggcatcggcagtagtgtgagcattgttagtgcggttttcatcatgttttatatcaaggaacgtatgtcgggggcaaaacttctacaaaatgcagcaggcgtggcgccttctgtgctgtggggcggcgcagcgatcttcaattggttttggttcctcatcacttgtgtttccatcgtcatctcgtgcgtcgcttttgatgtcatcgggttatcgaacgtgcatgaattaggtcgaatgtttttgtgcgtcatggtatacggtgcggcgatgttgccattagtgtaccttttgtcgcttaagttcaagggaccagctgtcggcttcgtgggcttctatttcctcaacgtgcttttcggtatgatgggtgcgcaggtggtggaggcactatcctctcctatgctggacacagagcaagccgcccacatccttgactacttactgcagttctacccgctttacagtcttgtcacttctatcaggtttttaaatcaagtcggcctacgggagtatacttgcttacaaggctgtgaatacttgcaggcagtatacccgaatctagagtgtagcatggcaagcatgtgcgaattccacagtaactgctgcgttcgtgaaaacccatacttcgattgggaggaaccaggcgtcctgaggtacttgctcagtatgtgcttctcctgcctaatcttctggttgctgcttatgaccattgaatacagagtggtgcaaaaggtgttcacattcaagaagactcctcctccaatagacgagagcacgttagacgaggacgtgatgacagaggcgaggcgcgcgcgccaggtgccgccgacacgccgcagcgaccacgcgcttctcgctcacgacctctccaagtactacgggaaacatctcgccgtagaccaagtctcgtttagtgtgaacgacggcgaatgcttcggtctattgggtgtgaatggtgccggaaaaacgaccaccttcaagatgctgatgggtgatgagtccatttcaagcggcgaggcgtatgtctccgggcactcggtgcagaggaatctcgatagagtacacgagaatattggatattgtccgcaatttgacgcattatttggtgagctgacgggtcgccagacactacacatgtttgcgttgatgcgcggcttgcgtttacgcactgcagcaccttcggctgaaacactcgcacatgcgcttggcttcttcaaacatcttgataaaagggtgcatcagtattcaggcggcacgaaacgcaagcttaacacggcgatagcattcatgggacgaacacggcttgtgtttgttgatgagcctaccactggagttgatcccgccgctaaacgccacgtatggcgcgctacccgcggcgtgcagcgagcaggtcgcggcgtggtgctgacgtcacatagtatggaggagtgcgaggcgttgtgttcgcgactgaccatcatggtcaacggtcgcttccagtgtctgggaacgccacaacatctcaagaacaaattttctcaaggctttactttaatcattaaaatgaaaactgacgacagtgacagcgacacgcagtcagtaaacagcactaccagcgtagtagatagtgtcaaactatacgtctctgggaactttgaaagtccaaagataatggaagagtatcatggtcttctaacttactacttgcctgaccgtagcatggcatggtcacgaatgtttggtatcatggagcgcgccaaacagatcttacaaattgaggactacagcatatcgcagactaccctcgaacaaatattcttgcagttcaccaaataccaaagagaagaaggaacgacgttataa

SEQ ID NO: 58 - DNA, 3749 bp, Helicoverpa zea
atgagattagaaacgaggcacgctagtgccgccaccaagttccgcctgctcatgtggaagaactttctgcagcaatggagacatcggctacaaactgtcgtagagctactattgccagtcgtgacaatggcgctggtgctcatccttcggtggcagataccgccttatcaaatcgatacactcacttaccccgcgttgccagcgcacacactcaactactctaccaatatcctttttgccatgaatatggaagaattatcaattgcatactccccggcaagtccagtgttagatgatgtaatgagaactgctgttattaatttactaacagccaatatgaaagatctgattcctatttttattgataacttaccaccggggatagccaatataacatttccaccagatatgaacttaaatacgtcggccattgaggagttcgtgaagtcacgaatacgagtcgtaccttataacagcagttatgaaataagagggatctacgttgacgaagaaactacacgcagcattatcgctgccgtcgagtttgacgataaactatatggagcagaacagttgtcaaataatttatcttattcgctacgttttcctgagagaccccgtctcaattcgtttttccaaactggagggcgcacctggagatctgacggagtattcccggttttcgaagtgcctgggcctagatttcctcactcgtgggaaggtggtaatgacccaggttacgttaacgaaatgttcgtggcacttcaacaagttatttccatggagctggtatcaagggcaaccgggttggacttgaagtcatttagggtgaacatacagaggtacccgcacccgccgtaccttcacgaccagtcagtggatctgctgcaatttatgttccccctgttcatcatgttgagcttcagctacactgctgtcaacattgcacgggcggtcacagttgagaaggaattgcaattaaaggaaactatgaaaattatgggcctccccacatggttgcactggacagcatggtttgttaaacagtttatctacctatcaatcacagctgttctgctagttgtgttgctaaaggtaaattggtttactaacgacgatggcttcagcgaatatgctgtatttactaatacaccttggacggttttgctattcttcttgatactgtatttatcttgcgcgatatttttttctttcatggtaagcagtatattttcaaaaggtagtacggccgcgttgtttatggcggtggcatggttcctcacttacatccctgctttcctcctggccatggatatcaatatgtcgactgcggtgcaggtcatcacatgcttcagtattaactctgcgatgtcctatggtttccaactaatgctcgctaaggaaagcactggagggctgcagtggggcgacttcatgacgtcaccagggacggacaccacgcgcttcgtgttcggccacgtggtcatcatgctggtagtggactgcctcatctacatgctgatcaccctctaccttgaacaagtgctaccaggccccttcgggactcccaaaccttggtacttccccttccagttgcagttctggttcccaaattataaatcgaaagatgctggattaattttcgaaaatgataatagtgaattcgatgatattataaaagaaaaggatcccacagaccacgaagttggtgttaaaatgcaaaatttaacaaaaatctttgggaataacatagctgttaacaatttatctttgaatatctatgacgaccaaatcacagttttacttggtcataatggtgctggcaaatcaactacaatatctatgttaacaggaaatttaaaggtaactcgcgggacagtgaacgttgccggatatgatatgacttctcaaagctccgcagcccgttcccacattggattgtgtcctcagcacaatatactgtttaacgaactcacggtcaaagaacatttggaattctttgctagactaaaaggatttaaaggcaaagaactgtatgaagagatagactcacttattgaaaaattggaactacaggagaagcgtgactacccctcaaaaggtctgtcaggaggtcagaagcgtcgtctttgtgttggtattgctctgagtggggcggcacgagtggtcttactcgacgaacctacgtctggcatggatccttcatctcgtcgagcactgtgggaactcttacagaaggaaaagaaaggtcgctcgatgatcctgacgactcattttatggacgaagcagatattctcggcgacagagtggctataatggcaaacggtagactgcaatgcgtgggctctccgtatttcctcaaacgtcattatggcgtcgggtataccctggtgatcgttaaggacacagacttcgactttgtgaaatgctccgtacttatcaatagctatattcctggtactattgttaaagaagatcgaggaacggaaatcacttataatttggtaaacgattactcacacgtttttgaagaaatgttgaatgatttggaaagaaatattgataacatcaaatttaaaaactatggtttagttgctactacattagaagatgtctttatgtccgttggtgcagacttaagtccaattaattccgaatctgacgatgctattactactactactgactcgactatcgatgatatattaaaacaagaaatcgattcatctttggaagaactggataaggacgagagtaacgtgacgggcctccgcttgttcggtcagcaagtgctggctgtatggatgaagcagtggctggtgctgatccgctcgccatgggtcatggtactgcagtttttggcgccagtggtactcatcaactccacgctaggagttctgcgttacgtcatgtctttatcaccgaccattagaactaggtggttgtcgttggaagaagggtatacggaaagcgaaactctgctcagcttcaacggtagtgtagcgtcatcagtgggtgccctagccgcgcaagcataccaaagcctgttcgccaattctggtgttatggacatggaaatcaacgctatcggaagccagccaatagaagaatattatctaaatagaacaagtgatcccgttgtgatgggttcgctgcggcaccgcttgctgataggctccacatttgacgacaactctgctaccgcctggttcagtaactttggctaccacgatgttgctacatcgcttgcggcaatccactcagctattctcagatctaaaaactctgatgcagtactcaatgtatataatcatccgttggaagcttcgtatatagatcagagtgacgtgcagactatgatagctatgttgtccatgcagttgtcctctggcatcggcagtagtgtgagcattgttagtgcggttttcatcatgttttatatcaaggaacgtatgtcgggggcaaaacttctacaaaatgcagcaggcgtggcgccttctgtgctgtggggcggcgcagcgatcttcaattggttttggttcctcatcacttgtgtttccatcgtcatctcgtgcgtcgcttttgatgtcatcgggttatcgaacgtgcatgaattaggtcgaatgtttttgtgcgtcatggtatacggtgcggcgatgttgccattagtgtaccttttgtcgcttaagttcaagggaccagctgtcggcttcgtgggcttctatttcctcaacgtgcttttcggtat

SEQ ID NO: 59 - DNA, 4014 bp, Helicoverpa zea
atgggcgtagaaaataagaataatgtacaaaatgcggaaggtccggcccgcaagacttacaaaaaaccgaacattttatcccgtatatttctctggtggatgtgtcctgtgcttataactggtaacaaaagaaatgtagaagaatcagatcttataccgcccagtaatttatataattcagaaagacaaggagagtatcttgaaagatactggttggcagagatagaaaatgcaacaattgaaaatcgggagccatcactatggaaggcattacgaaaggcctactgggtctcctacatgccaggagctatttttatcatcattcaatctgcagccaggacgtatcagccgctgttgttttctcagttactgtcgtactggtcggtggacagtgaaatgactcagcaagacgctggcctctatgctctcgccatgctgggactgaacttcgtctccatgatgtgtcagcaccacaacacactgtttgtgatgcggttcagtttaaaagtcaaggttgcctgttcttcgcttttgtataggaagttgctccgcatgacccaagtgtcggtgggtgaggtggcaggaggaaagctggtgaacttgctgtccaacgatatcacgaggttcgactacgcgttcatgttcctacattacttgtggatcgtgcctatccaagtggctgttgttttgtatttcttgtgggaggctgctggcttcgcacccttcgtcggtctgtttggagtcgttatactgattttaccactgcaagctggcttgacgaaactcacaactgttgtaagacgtgagacggctaagagaacggacaggcgaattaaactaatgagtgaaattattggtggtattcaggtcattaaaatgtacgcttgggagaaacccttccagctagttgtgaaggcagctcgtgcctttgaaatgagtgccctcaggaagtccatcttcatcaggagtactttcctagggttcatgttgttcactgagcgaagcatcatgtttgtcacagtgttgacactcgctctcacaggcactatgattactgccactacgatataccctattcaacagtacttcagtattattcagtttaacgtaacactgatcattcctatggcaatcgcaagttattccgagatgatggtgtccatagaacgtatccagggattccttagtttggacgagcggtccgacatgcaagtgactccaaaaattaatggatctaacaataacactttgtttaaatccaagaagtcaccacttgaagtaggcatcgtgcctaagaaatactcacctagtgaagttatggctgcaaaggagatgcaggatgatcctacccagatggactatcctatcaggcttaacaaagtaagcgcatcgtggaccggcagcaatagttcttcagaaatgacacttaagaatatatcgttacgtattcgtaaaggaaaattgtgtgctatcattggtcctgtggggtccggaaagacatctctactgcaactgctcttaaaagaattaccattgaatagtggtacacttgacgtgagcgggaaaatgtcgtacgcttgtcaagagtcctggctgttcccaggcacagtacgagaaaacattttgttcggcctaacttacgaacccacaaaatacaaagaggtttgcaaggtgtgttcgttgctgcctgacttcaagcagttcccgtatggtgacctgtctttagtgggagaacgaggagtgtccctgtcaggtggtcaaagagccaggatcaatttggctagagcaatttatcgtgaggccgacatttacttgctggatgatcccctatctgcagtggacgctaatgtaggcagacaactgtttgatggctgcatcaaaggctacctcactggacgaacttgcgtcttggtcacccatcagatccattacctcaaagctgctgattttattgtagtccttaatgagggttccgtcgagaatatgggcacttatgatgagctggtgaagacaggaactgaattctcgatgctgctatccaaccaagaaaatgacgcaactgaaaacgaaaagaaagaccgaccagcaatgatgcgaggaatatcaaaaatctcagttaagagcgacaccgaaatggaacagaaggctcaaatacaggaggcagaggagagagcgacaggtagcttgaagtttgaggtggtgctcaagtacctgagctccgtccagtcctggtgtctggtgtttacggcgttccttgtactgctgatcacgcaaggtgctgccaccactgccgactattggttgagtttctggactaaccaagtggattcttatgaacaatctttacctgaaggcgtggatccagatactgacatgaacgcacaaattggcttacttacaactgcccagtacctatacgttttcggtggagttatattggctttaatagtcatgaccctcgtcagaatcacagctttcgtagcgatgacaatgcgagcttctcaaaatcttcacaacactatttacgaaaaattaattgtgacagtaatgagatttttcgataccaatccttctggtcgtgtgctgaacagattctcaaaagacatgggtgccatggatgagcttcttcctcgcagtcttttagaaacagttcagatgtatttgtcgctgaccagtgtgttggtgctgaacgccactgcattgccctggacgcttatacctacctccgtgttgattgtcatcttcgtgctcatgttgagatggtacctgaatacagctcaggctgtcaaacgtttggagggcacaaccaagagtcctgtatttggaatgattaactccactatttctggactctccactattagaagttcgggttcccaggatagacagatgaaattgtttgacgaagcgcagaatctccacacaagtgctttccacacattcttcggcggttctacggcatttgcattgtatctcgatactttgtgtttgacctacctcggtgtcgtcatgtcaattttcattttgggcgactttggtgatttgatcccggtgggaagtgtcggtctggctgtcagtcagtccatggtgctgaccatgatgttgcagatggcagctaggttcacagctgactttttggggcaaatgacggctgtggagagagttctggaatacaccaagctacccacggagaccaatatggagcaaggaccaactaacccaccaaaggaatggcccagtgctggtagagtgacgttctcaaatgtgtacctgaattattccatggaagacccgccggtgctgaaggacttaaactttgaaattcaaagcggctggaaggttggagttgtaggcagaacaggagccggcaagtcatcgctcatcgcggctttgttccggcttagtgacataagcggcagcatcaaaattgacggtgtggacaccgaaggattagccaaaaagactttgagatcgaaaatatcaattattccacaagagccggtgctgttctcggctactctgcgatacaatttggacccgttcgacgattacagcgacgacgatatttggagggcgttggaacaggtggaattaaaagaaggaataccggctttagactttaaggtcgctgaaggtggtactaacttctctatgggacaacgtcagttggtttgcttggctcgtgccattctacgctctaacaaaatactcatcatggacgaagctaccgctaacgtcgatcctcagacggacgctttgatccaaaagacgatccgtcgtcagtttgcgtcgtgcacggtgctcaccatcgcgcatcgactgaacaccatcatggactccgaccgagtgctggtcatggaccagggcgaagtggccgagttcgaccatccccacatcttgctcagcaaccccaatagcaagttcttctctatggtccgagagacaggagaaagcatgacaaggaccttaatggaggtcgctaaggccaaatatgatagtgataataaggaagct

SEQ ID NO: 60 - DNA, 5229 bp, Helicoverpa zea
atgagattagaaacgaggcacgctagtgccgccaccaagttccgcctgctcatgtggaagaactttctgcagcaatggagacatcggctacaaactgtcgtagagctactattgccagtcgtgacaatggcgctggtgctcatccttcggtggcagataccgccttatcaaatcgatacactcacttaccccgcgttgccagcgcacacactcaactactctaccaatatcctttttgccatgaatatggaagaattatcaattgcatactccccggcaagtccagtgttagatgatgtaatgagaactgctgttattaatttactgacagccaatatgaaagatctgattcctatttttattgataacttaccaccggggatagccaatataacatttccaccagatatgaacttaaatacgtcggccattgaggagttcgtgaagtcacgaatacgagtcgtaccttataacagcagttatgagataagagggatcaacgttgacgaagaaactacacgcagcattatcgctgccgtcgagtttgacgataaactatatggagcagaacagttgtcaaataatttatcttattcgctacgttttcctgagagaccccgtctcaattcgtttttccaaactggagggcgcacctggagatctgacggagtattcccggttttcgaagtgcctgggcctagatttcctcactcgtgggaaggtggtaatgacccaggttacgttaacgaaatgttcgtggcacttcaacaagttatttccatggagctggtatcaagggcaaccgggttggacttgaagtcatttagggtgaacatacagaggtacccgcacccgccgtaccttcacgaccagtcagtggatctgctgcaatttatgttccccctgctcatcatgttgagcttcagctacactgctgtcaacattgcacgggcggtcacagttgagaaggaattgcaattaaaggaaactatgaaaattatgggcctccccacatggttgcactggacagcatggtttgttaaacagtttatctacctatcaatcacagctgttctgctagttgtgttgctaaaggtaaattggtttactaacgacgatggcttcagcgaatatgctgtatttactaatacaccttggacggttttgctattcttcttgatactgtatttatcttgcgcgatatttttttctttcatggtaagcagtatattttcaaaaggtagtacggccgcgttgtttatggcggtggcatggttcctcacttacatccctgctttcctcctggccatggatatcaatatgtcgactgcggtgcaggtcatcacatgcttcagtattaactctgcgatgtcctatggtttccaactaatgctcgctaaggaaagcactggagggctgcagtggggcgacttcatgacgtcaccagggacggacaccacgcgcttcgtgttcggccacgtggtcatcatgctggtagtggactgcctcatctacatgctgatcaccctctaccttgaacaagtgctaccaggccccttcgggactcccaaaccttggtacttccccttccagttgcagttctggttcccaaattataaatcgaaagatgctggattaattttcgaaaatgataatagtgaattcgatgatattataaaagaaaaggatcccacagaccacgaagttggtgttaaaatgcaaaatttaacaaaaatctttgggaataacatagctgttaacaatttatctttgaatatctatgacgaccaaatcacagttttacttggtcataatggtgctggcaaatcaactacaatatctatgttaacaggaaatttaaaggtaactcgcgggacagtgaacgttgccggatatgatatgacttctcaaagctccgcagcccgttcccacattggattgtgtcctcagcacaatatactgtttaacgaactcacggtcaaagaacatttggaattctttgctagactaaaaggatttaaaggcaaagaactgtatgaagagatagactcacttattgaaaaattggaactacaggaggagcgtgactacccctcaaaaggtctgtcaggaggtcagaagcgtcgtctttgtgttggtattgctctgagtggggcggcacgagtggtcttactcgacgaacctacgtctggcatggatccttcatctcgtcgagcactgtgggaactcttacagaaggaaaagaaaggtcgctcgatgatcctgacgactcattttatggacgaagcagatattctcggcgacagagtggctataatggcaaacggtagactgcaatgcgtgggctctccgtatttcctcaaacgtcattatggcgtcgggtataccctggtgatcgttaaggacacagacttcgactttgtgaaatgctccgtacttatcaatagctatattcctggtactattgttaaagaagatcgaggaacggaaatcacttataatttggtaaatgattactcacacgtttttgaagaaatgttgaatgatttggaaagaaatattgataacatcaaatttaaaaactatggtttagttgctactacattagaagatgtctttatgtccgttggtgcagacttaagtccaattaattccgaatctgacgatgctattactactactactgactcgactatcgatgatatattaaaacaagaaatcgattcatctttggaagaactggataaggacgagagtaacgtgacgggtctccgcttgttcggtcagcaagtgctggctgtatggatgaagcagtggctggtgctgatccgctcgccatgggtcatggtactgcagtttttggcgccagtggtactcatcaactccacgctaggagttctgcgttacgtcatgtctttatcaccgaccattagaactaggtggttgtcgttggaagaagggtatatggaaagcgaaactctgctcagcttcaacggcagtatagcgtcatcagtgggtgccctagccgcgcaagcataccaaagcctgttcgccaattctggtgttatggacatggaaatcaacgctatcggaagccagccaatagaagaatattatctaaatagaacaagtgatcccgttgtgatgggttcgctgcggcaccgcttgctgataggctccacatttgacgacaactctgctaccgcctggttcagtaactttggctaccacgatgttgctacatcgcttgcggcaatccactcagctattctcagatctaaaaactctgatgcagtactcaatgtatataatcatccgttggaagcttcgtatatagatcagagtgacgtgcagactatgatagctatgttgtccatgcagttgtcctctggcatcggcagtagtgtgagcattgttagtgcggttttcatcatgttttatatcaaggaacgtatgtcgggggcaaaacttctacaaaatgcagcaggcgtggcgccttctgtgctgtggggcggcgcagcgatcttcaattggttttggttcctcatcacttgtgtttccatcgtcatctcgtgcgtcgcttttgatgtcatcgggttatcgaacgtgcatgaattaggtcgaatgtttttgtgcgtcatggtatacggtgcggcgatgttgccattagtgtaccttttgtcgcttaagttcaagggaccagctgtcggcttcgtgggcttctatttcctcaacgtgcttttcggtatgatgggtgcgcaggtggtggaggcactatcctctcctatgctggacacagagcgagccgcccacatccttgactacttactgcagttctacccgctttacagtcttgtcacttctatcaggtttttaaatcaggtcggcctacgggagtatacttgcttacaaggctgtgaatacttgcaggcagtatacccgaatctagagtgtagcatggcaagcatgtgcgaattccacagtaactgctgcgttcgtgaaaacccatacttcgattgggaggaaccaggcgtcctgaggtacttgctcagtatgtgcttctcctgcctaatcttctggttgctgcttatgaccattgaatacagagtggtgcaaaaggtgttcacattcaagaagactcctcctccaatagacgagagcacgttagacgaggacgtgatgacagaggcgaggcgcgcgcgccaggtgccgccgacacgccgcagcgaccacgcgcttctcgctcacgacctctccaagtactacgggaaacatctcgccgtagaccaagtctcgttcagtgtgaacgacggcgaatgcttcggtctattgggtgtgaatggtgccggaaaaacgaccaccttcaagatgctgatgggtgatgagtccatttcaagcggcgaggcgtatgtctccgggcactcggtgcagaggaatctcgatagagtacacgagaatattggatattgtccgcaatttgacgcattatttggtgagctgacgggtcgccagacactacacatgtttgcgttgatgcgcggcttgcgtttacgcactgcagcacgttcggctgaaacactcgcacatgcgcttggcttcttcaaacatcttgataaaagggtgcatcagtattcaggcggcacgaaacgcaagcttaacacggcgatagcattcatgggacgaacacggcttgtgtttgttgatgagcctaccactggagttgatcccgccgctaaacgccacgtatggcgcgctacccgcggcgtgcagcgagcaggtcgcggcgtggtgctgacgtcacatagtatggaggagtgcgaggcgttgtgttcgcgactgaccatcatggtcaacggtcgcttccagtgtctgggaacgccacaacatctcaagaacaaattttctcaaggctttactttaatcattaaaatgaaaactgacgacagtgaaagcgacacgcagtcagtaaacagcactaccagcgtagtagatagtgtcaaactatacgtctctgggaactttgaaagtccaaagataatggaagagtatcatggtcttctaacttactacttgcctgaccgtagcatggcatggtcacgaatgtttggtatcatggagcgcgccaaacagatcttacaaattgaggactacagcatatcgcagactaccctcgaacaaatattcttgcagttcaccaaataccaaagagaagaaggaacgacgttataa

SEQ ID NO: 61 - DNA, 5124 bp, Diabrotica virgifera
atgggagaaaaattggataaatttttgttgttaatgtggaagaattggctgctgcaatatagaaaaccaattcaaaccataatagaaattgtcgctcctgttctcttttcattccttttagtctacatcagaagtttgtcggatccgacatatgaacatgaaagaatatataagccattttgtgctttcgagggaaacttcaaccttagcctaccgcttttttgtaatgacccagatgctgtgcaagcaggaccatcattatttagtagtatgcaaactggtgatagcaatttcagccttacaatattatatactgctccagaagataaatactacgacgatgtagtaggcttctttaagttaataccaaaagtcaacactcagcgtgtaataagctcaggcgaattagaaagaatatcattagctggaaactcatcctattatggtatcgagtttggaggggatagagacaatgtagaggttaatataagatttccaggagaaacagtgtatcaattagattcgattgggcgtcaaaattggaggaccaacttagtgtacccagtatttcaaagctctggtccaagatcccccgacaatgctactggatcagcaccaaattattttgctgaaggatttttggccgtacaacattttgtgactactgctcttcttctagcagataagggtattacacacgacgatccacagggaatgtttaattttttgatggacgcgtctaatccatttcctctcatacagatgcaacgttttccattcgcaagttggttcagtgatcaacttctaacagcgcttacgagcatgcttggaatgattgtcatgcttagttttgtctacacttgtataaatacagtcaaatctatcaccacagaaaaagaaaaacagttaaaggaatcaatgaaaattatgggactacctaattggctacattggttggcctggtttgtcaagtgcttcatttttgttataatttcggtagcacttatggtagtacttctcaaagtaaggtggtactcgaatacagaattcacagtattcacctatgcagacccattcgttttgtttgtatttctcctgctatattgttgctctatgatcactttttgctttgctctgagcgtcttcttttccaaagcaaatactgcagcaactatggcaggtttggcatggttcatatcttatgctccttatctcttcatgcagaataactacactgatcttgcattatctactaagctattaacaagtttgttgccaaatactgctatggcttttggatttcaagttgtacttatgtatgaaggaactggagatggtgtgacctggagcactctgtttaaaccaaacaccccagatgacaccttgagcctgggattaatatggataatgatcataataaacacaataatctacctattaattgctctctacatagaggcagtatttccaggagaatatggagtagctgaaaaatggtacttcccattcacaaagaaatactggtgtggaaaaggagctgtatcagattataataactataatgatcattcagcaaatgaattctttgaaaccgaaccaaaccttagacctgggattcagatattcaatctgaaaaaagcttttggcaagaaaacggctgtacggaatctaagcttaaatatgtttgaaaatcaaatcacagttttgttgggtcacaacggagctggaaaaactacgacgatgtccatgttaacaggaatgataagcccaacaaacggcacagcaaaaatcaatggtcatgatatccggttagacatcgcaggagtcaggaatagcttgggcctttgtccacaacacaacatcattttcgacgagctcaccgtcgaagagcacttgtacttcttcagcaaactcaaaggtttgtctaaaagcaaaataacagcagaaatagataaatacgtcaagctgcttgatctggagccaaagaggaaggagaaatccagtactctatcagggggaatgaaaagaaaactttgtgttggaatggccttgtgtggaaattcgaaggttgttatgttggacgaacctactgctggaatggatccatcagcgagacgagtgttgtgggaattattacagaaacaaaaagagggtcgaacaatattgctcagtacacattttatggacgaagctgatcttttaggagatagaatagcaatcatggctggtggagaattacaatgctgtggatccagcttcttcttgaagaagaagtacggtgcgggatacagtcttattatggataaagcgaaaacttgcaatccacataaagttacagaactgctgaagaagtttataccagagatagagatccatagcaatgttggaagtgaactaacttacttgttatctgaaaataatgctcctgtattcgaagcaatgttaaaacaaatagaacaagaatcaaatgaacttggaatcaggagctatggtatttctttaaccactatggaagaagttttcatgaaagttggtgcagaccacggacaagaagaaatttacaatgaaaaacagaaaaaggacaaaaaagaaaaaaatcctatactcacttctgctgatttaggtccagaatctttatctccctcgtacactggtggtttacatttgattgtcaatcagttcgtcgcaatgcttatgaagaagattataggaacctttagatcatgggttttgttggcgattcagatatttttgcctatgataaacgttattatagttatgagtgtaccttcaggaagtgttccctctgttttgccggcaatgcctttaaatttagcaagattcactgaccctattactttaattgagcgatttgacgatccacaaaattatacgaataacttctacggtgttttaaatggatatggaatgtctccaacaaacattgacaatattacccgtataatgttagacctgactgcaactaatccaaacgtagtgcgtagaagttacattataggatcaactttcacagagcaaggatttgaatttggtatcatcaagacaattcatccagttattacggcatggtttaacaatgatccttaccactcacctggtattgccttaggcatggctttgtcttccgtttacaatcactacactaacggacatattgaatttgttaacaaaccattaccttttaaagctgcaacccaaatagacaacattgttggtggacaatctcagggattccagtttgcatttaatattggattcagtatggcgtttatctcatcattttatgttatattcttgataagagaaaacgtatccaagtcaaaacacctgcagtttgtatcaggagtgaaggtttacattttttggcttgttaatataatttgtgatatgtttgtctacttactggtatgttcagtattattgatcactatatattgtttccaacaagatgggtttaagacaagtggagatatgggtcggctatttttcctattacttttgtttggttggtcgtttatgccaatttattatgtagcatcattaatattcacagttccatcgacgggttacacaaggatgactctcgtgggtatattcatagggaatgcagcttttcttttagttgaagtgcttaaaacgcaaagcacaaacctaaaacgtataggagaaaccttggataacgtttttcttgtgttcccgcactattctttagctacaggaataaacaaatgctacgctatctattcatacaacactctttgtgaaacagtatttgactcgtgtgctcaaaataattttactaaagatgagtgcatttcaaaatttccatccactgtcgctgatatttgtaccaatcttaacgacaactacttttcatggaacaataatggtatcgcaaaaaatgtaacgtactcactgatttctggtgtcttgtgggcaatattactatttatcatcgaatacaaattcatagccagactgatgtactacatcaaccaaaaattcttcccgaaacaaccaattctcattcaagacgaagacgacgacgtatccaaagaaaaagaaaggattcacatggccacagatcatgatatacgtcaaactaacattttagtcgtgaaagatttaaccaaatactacaacaactttttagctgtgaatgggttgtctattggaattgaaaagtctgagtgctttggtttgttgggtattaatggtgcaggaaaaactacaacatttaaaatgatgagcggagatgaaactgtatcttacggtgatgcatggatcgaaggaaagagtgtaaaaacgcaactgaagcaagtacaacgaaacatcggctactgtcctcaattcgacgctttgctggatgatatgacagcaagagaaacaattatcatgtactgcctactcagaggaatagagtttaaaagaacccaaagaattgcgaatttcttgtctcgagacttcgattttcatcgtcatttggacaagaaagttaaagagatgagcggtggaaataagaggaagttaagtactgttttgtcgttgataggggatccgccagtactatttttggacgaacctacaacaggtatggatccagcaacgaaacgttacctgtgggattcattatgcaaaattcgagacaacggcaagtgcatcgttctaacttctcacagcatggaagaatgtgaagccttgtgcactcgaatagccattatggtgaacggcaatttcaaatgtcttggatccacacagcatcttaaaaacaaatttgcggagggatacaccttaaccataaaactaaagaaattgccagagagcggtggtctggtacatgcagatacagagtcactggagaagtatatcaaagataaatttccttatgctcatcttagagagaaacatcaagaactattgtattattatataaccgacacttccatggcatggtccactatgtttggtatattagaaagagctaagcgaagtgatctgaatattgaagactattctttgggacaaagtagtctagaacaggtattcctaacgtttacaaaacaccaaaatccagaaggtgacgatgttaagaagaagaattag

SEQ ID NO: 62 - DNA, 3768 bp, Diabrotica virgifera
atgacagaagaaaaaaaacatagtataaaggataaagagaaaattggtattgatgcccaatttgttaatagtgaagaaccaaaggaaaaaattaagaatgtatcttttcctcagatgtttaggtatgcaagtacttatgataaatttttaatggtagtaggacttatatcggcaactggaacaggagtcttacaacccctaaatacgattctctttggtagcctcacaggagatatcattgcatatgctacgtcgatacagataaatttacctgccgatcagaagaaaatagcagaagacaatttttttgatggtatccgatattttgccctaatgaattctctgatcggaataggaatgtttgtgttcagttacctagcaacagtcacttttaactattctgctatgagacagatattcaaaataaggtcagcatatttgaaatccattttaaaccaagatgtaggttggtacgatattaatcagactggagattttgccagtaggatgtcagatgatttgttcaaatttgaagatggcataggtgaaaaagtaccggtattctggagttttcaagttgtttttttaacttcacttatcatagctcttgtgaaaggatgggaacttgctttaatatgtttaacctctctacccgctacattaataacaatcggaattgtaggacttctcactacaaaattagcaaaaaatgaactggaagcatatggcgctgctggatcaatagccgaagaagcattgtctttaattagaaccataacggcttttggaggtcagaagaaagaagtagacagatataataaaaatttagttgaagccaaaaacaataatataagaagatcgatgttttcagcattaggtttcggtttattgtggttcatgatctatgccagttatgctctggcattctggtatggtgtaaaattagttttaagggacaggacagctacgaatcaaatatatactcctagtaatatggtgactgttttctttagtgtcatgacaggatctatgaactttggtattgcctctccatatatagaggcatttggaatctcaaaagcggcggcgtcaaaaatttttagtgtaatcgatcacaaacctacaattaatttatcaaaaggaaatggaaaaacgctaaacgtactcataggaaatatacaatttaaagatgtggctttccgttatccatctaggaaagatgtaccgatattaaaaggattaagtttgaacattaaatctggagacactgtggcacttgtaggtagttcgggctgtggaaaatctacggttattcagttacttcaacggttatacgatgcggactctggagaggtcaccatagacggaaaaaatattaaagaatacgatttaacttggttaagaagccaaataggagttgtaggtcaagaaccaattctctttggaacatccattttagaaaatattaggtacggtaaagatggagtaacagaggaagatttcattcaagcagctaaaaaagctaatgcgcataactttattaaagctcttcctaacggatataatacattggttggagagaaaggggctcaactctcaggtggacaaaaacaaaggatagctatagctagagctttggtaagaaatcctactttattacttttggacgaggctacttcagcactggataataccagtgaagctaaagtacaagcagctctagatgcggcaagtgttgaatgtacaactataattgtggcacacaggctatcaacaattcgaggtgcaaacaaaattatcgtactttctcaaggagtcgtggtagaagaaggaacccacgaagaactaatggaacttaaacaagagtattatagattagtaacagcccaagtcaaatcatcggaacagtttgaagtcgctgaaaagaagaaagtggtaagagctattagcttggcagaaagtagcacaggctctgaccataacatagaggctacaaaagaagataatgaagacgattttaatgaaaataaagacgtttccgtttttgaaatattgaagatgaatgctccagaatggccttacattttatttgctggtcttggatcaattgttgttggttgtggaatgcccgtttttgcagtcttgtttggtagcattttggggacattagcaaatggtgatcctgactttgtaagatctgaaaccaacaaatattgcttatattttgtgctgggaggactcataactatggtatcagtatttactcagatgtacctgttaggaattgctggtgaaaaaatgacagaaagagttaggagtcgattattcaaggcaatgatataccaggaaataggcttctttgacaagaaaacaaatggggttggagcgctttgtgccaaattgtcttctgatgcttctaatattcaaggggcaacaggaattcgggttggaaccattcttcaatcaatagccacattttgcttagcaattggtctttccatgtattatgaatggaaattgggtttagttacagcagctttcacacctgttattttgatcgctatgttctttgaaagaagaaacaccagaggtggaaacgattcaagagattccgcactacaaaaatcaacaaggactgcagtagaagccgttgggaatatacgaacggttgcctccttgggcttagaagaaaagttccagcaactatatgaatctgagctcatgccacattataaatcttcgttaaaaacagttcactggagagcaatcgtgtttggtctttccagaagtttgttgttctttgcttatgctactgcaatgtattacggcggatttttgataagggatggattgccatacgatagagtatttaaggtatctcaagcacaaattatgggtacagtttcaattgccaactcactggcattttctccaaactttgctaagggtgttgcagcagcaaaaaaagttaaaagcttcctttcaagaattccacttattcgtgatttaccttcttcacgacaaatggttaaggcaagtggcaacttcagtttttcagaaatcgaatttacgtatccaacacgacccaacgtactaattttaaaaggacttaatttggacattctaaatggaaaaactgtagctctagtgggagaaagtggttgcggaaaatctacgataattcaactcatcgagagattttacgatcctagatctggtgaagtaaaaatggatggtgtagatttaaaagatatatcactagattcgttgaggtcgcatatgggtatcgtatcacaagaaccaaatctgttcaataagtctattgctgaaaatattgcttatggagataattcaagggaggtttctatggatgagataattaaagctgctaaaaatgccaatattcataattttataactggattaccgaagggatatgaaacaaaactaggagaaaaggctgttcagttgtctggtggacaaaaacaaagaattgctattgccagagcgttagtaagaaatccaaaagttttactccttgatgaagccacatctgcactagacactgaaagtgagaaggttgttcaagaagctctagatcaagctaaaaaaggaaggacatgtgttacgattgcccacagattaacaaccatacaagatgcagacttgatatgcgtagtagcaaatggtgtaattgctgaatctggaagccatcaagaacttctgcaaaaggagggactgtactacaaattatatactcaaaaaacg

SEQ ID NO: 63 - DNA, 3507 bp, Diabrotica virgifera
atgaaagaacgaaaaaaatatagtataaaggataaacagaaaaatgttcttgatgccaagtttgttagtagtgaagaaccaaaggaaaaacttcaaaatgtttcatttcgtcaaatgtttagatattcaagtggatacgacaaattcttaataacaataggacttatctcttcaactggagcaggaatcttacaacctttaaacacacttatcttcggtagtcttacgggtgatattattgaatatgctacatcaatgcaaagaaatttatcagctgatcagaaaaaaatggcagaagacaaattctttgacgctatacgatattttgcaataatgaattctgtgataggagttggaatgtttattttcagttatcttgcgactgtcagtttcaactattctgctataagacagattttcaaaataaggtctgcatatttaaaatctattttaaatcaagatgtaagctggtacgatgtcaatcagactggagagtttgccagcagaatgtcagatgatttgcacaaatttgaagatggtataggagaaaaagtgccgatattctggagttttcaagttgtttttttaacttcaattatcatagctcttgtgaaaggatgggaacttgctttaatatgtttaacatctctacccgcaactttgataatagtccgcactgtaggaatcctaaccacaaaattagcaaaaaatcaaatggaagcttatgccgcagctggctcaatagcagaagaagcattatcattaatcaggacagtgacagcttttggaggtcaaaagaaagaagtagagagatataacaaaaatttagttttagccaagaaaaataatataagaagatcgatgctttcagcgttaggttttggtctattatggttgatgatttattccagttatgctctggccttttggtatggggttaaattagttttgagggacagagcagttacgaatccaatatatactcctagtaatatggtaactgttttctttagcgttatgtccggagctagtaatttcggtggagcatcaccttatatagaggcatttggaatctcaaaagctgctgcttcaaaaatttttagtgtaatcgatcataaacctacaattaatttatcaaaagaaaatggaaaaacactagatgtactcaaaggaaatataagctttaaagacgtgaattttagttatccatctagaaaaaatataccagtattaaaaggattaagtttgaacattaaatctggagacactgtggcacttgtaggtagttcgggctgtggaaaatctacggttattcagttacttcaacggttatacgatgcggactctggagaggtcaccatagacggaaaaaatattaaagaatacgatttaacttggttaagaagccaaataggagttgtaggtcaagaaccaattctctttggaacatccattttagaaaatattaggtacggtaaagatggagtaacagaggaagatgtcattcaagcagctaaaaaagctaatgcgcataactttattaaagctcttcctaacggatataatacattggttggagagaaaggggctcaactctcaggtggacaaaaacaaaggatagctatagctagagctttggtaagaaatcctactctactgcttttagacgaagctacttcagcgctggataatactagcgaagctaaagtgcaagcagccctggatacggctacggaagaagataatgatgatgatttcaaggaaaataatcacgtttccgtttttgaaatattaaagatgaatgctccagaatggccttacattttatttgctggtcttggatcaattgttgttggttgtggaatgcccgtttttgcagtcttgtttggtagcattttggggacattagcaaatggtgatcctgactttgtaagatctgaaaccaacaaatattgcttatattttgtgctgggaggactcataactatggtatcagtatttactcagatgtacctgttaggaattgctggtgaaaaaatgacagaaagagttaggagtcgattattcaaggcaatgatataccaggaaataggcttctttgacaagaaaacaaatggggttggagcgctttgtgccaaattgtcttctgatgcttctaatattcaaggggcaacgggaattcgggttggaaccattcttcaatcaatagccacattttgcttagcaattggtctttccatgtattatgaatggaaattgggcttagttacagcagctttcacacctgttattttgatcgctatgttctttgaaagaagaaacaccagaggtggaaacgattcaagagattccgcactacaaaaatcaacaaggactgcagtagaagccgttgggaatatacgaacagttgcctccttaggcttagaagaaaagttccagcagctatatgaatctgagctcatgccacattataaatcttcgttaaaaacagttcactggagagcaatcgtgtttggtctttccagaagtttgttgttctttgcttatgctaccgcaatgtactacggcggatttttgataagggatggattgccatacgatagagtgtttaaggtatctcaagcacaaattatggggacagtttcaattgccaactcactggcattttctccaaactttgctaagggtgttgcagcagcaaaaaaagttaaaagcttcctttcaagaattccacttattcgtgatttaccttcttcacgacaaatggttaaggcaagtggcaacttcagtttttcagaaatcgaatttacgtatccaacacgacccaacgtactaattttaaaaggacttaatttggacattctaaatggaaaaactgtagctctagtgggagaaagtggttgcggaaaatctacgataattcaactcatcgagagattttacgatcctagatctggtgaagtaaaaatggatggtgtagatttaaaagatatatcgctagattcgttgaggtcgcatatgggtatcgtatcacaagaaccaaatctgttcaataagtctattgctgaaaatattgcttatggagataattcaagggaggtttctatggatgagataattaaagctgctaaaaatgccaatattcataattttataactggattaccgaagggatatgaaacaaaactaggagaaaaggctgttcagttgtctggtggacaaaaacaaagaattgctattgccagggcgttagtaagaaatccaaaagttttactccttgatgaagccacatctgcactggacactgaaagtgagaaggttgttcaagaagctctagatcaagctaaaaaaggaaggacatgtgttacgattgcccacagattaacaaccatacaagatgcagacttgatatgcgtagtagcaaatggtgtaattgctgaatctggaagccatcaagaacttctgcaaaaggagggactgtactacaaattatatactcaaaaaacg

SEQ ID NO: 64 - DNA, 5280 bp, Agrotis ipsilon
atgggtgtcgacgtccgaatcctgaccgcagcgctggtgctgcttgctgcttcgagtactacatcggcacaaggtatgccctttgaatcccgatgtgcttacatgacggatattccaaggccagacgaaagacctgaattaccacctataatttatgatggactgtcatggaacgaacgaccactggtgcctgccaacgaggataggcttgacgtatgcatggatgagtttttccgtggtatgcagtatatcttcatggaggaagagatccatggcgacgtacccatcgccaagttaaactacataggtgacaaaattccttacgtacattctacctttaccgttgggtcattcagattgcttggtccagaaatacgtaaaataagtggagactggcacctcgttataacgaacaggcaggattacgaggccgggacgtggtttcatgcgttcacaataagaatagataacgaggtcgacgctgaggtgatgctcgcgatcgtcaacatcgacgacaacgatccccttatcgatttgtcagaaccttgtcagatagctgaacaaagagatgctagaagtgtgaagacttgtaggtacatagtgcatgacgttgacggagagatcagtacgagatttatgcgctacgaaattgaaagtggtcgaggagacgaagaagtcttcagtttggtcagagagcaagccccgaataacgaatggatgtggtgttacatggtggtggaagttaaaggatccctcgactttgcgcagaacccacttcatatattccgagcccatgcttttgattcgaaagataatacgcacagcgtattaatgacggtcgaagtaaagaacgtggaacagagaccgccgcaatggattgagatcttcgccgtgcagcaattcgacgagaagatcaagaaatcgttcagagtaagggctatagatgctgacacgggaattaataagacaataagctatcggctacgaactgctgtgggagaagaaaatttatttgaacttgaaacgaaagaagggagtcaaggtgtatggcttcatgttgggcctatagacagagatgaactcgaaaaagaagtgttcttgttgtctataatagcatacaagtacggtgacgatggtacattgtacgagacgcctgccaacatcactattataatcaacgatgtcaatgaccagctaccaagtcctctcaaagaaggcggtgtatacactattgacatcatggaggagactcccatgactctcaatttagaaaacttcggttttcatgatcgtgatctaggaccaaacgcacaatataatgtgcgcttggaaagtgtttatccagacggagttcatgaggcattctatatcgccccagaacgtggctaccagcggcagtccttctttttgagcacacagaaccatcacatgcttgattatgacaacgaaacagttgattttacgaaaattcaaataaaggcggtggcaatagactcgcttaacaataccatgaaaggattcgcaacgatcaacattaacctgattaactggaacgacgagctgccgatcttcaagaattctgtgcagaacgtctcgttccccgagacggtggcggccggctttcacgtagcgaccataaaggctgaagacagggatgtaggcgatagagttgagcattcgctgatgggcaacgctgtcgattttctgactattgataaatacagcggcgaaatcttcgtggcagtcaataattctttcaactatcacaggcagaacgagctgtttatacagattagagccgatgacacgctaggcgaaggcccttaccacaccaccacctcccagctggttatatatctagaggacgtcaacaatacacctcccgtcctcagacttcctcgcaggggtccgcatgtggaagagaacgttccgcatgggcacccgatcaccaatgatgacgggatccaattgatcgcctctgaccccgacaccacggctgaactctggttcgagatcgactgggaggaatcctatgccaccaagcagggcaacgagacactcaaagacgagtaccgaaattgcatagaaattttgacacgataccaggacgaaaacaggaaaggcgaagcatacggggtcttggaggtgcgacagatcagggacgacccagttgtgaccattgactacgaggagttcgaggtgctgtatctcgtcgtcagggtcagggataggaacaccacactcggagacgactatgacgaaggcacattgacgatcacgatcatagatatgaatgacaactggccaacctgggaggaggggcagctgacgcaacagttccgcgttcgagagatgtcactcagcggcgtcgttatcggctccttgcgcgccaccgacagggacggcccgctctacaaccaagtgcgctacaccatccaaccagtagacgggactccagcggatctagttgcaattgacttcaggactggccagatgacggttcagaagaaccaagctatagacgcagacgtgccaccaagatttaacttgtactacaccgtcacagccagcgacaaatgttctatggaagaccagtcgaactgtccggatgataaaacttattggaatacaactgcaaaaatagcgatccaggtaatcgacacaaacaacaaggtgcctttcgtggagcccgaaaagttcaaaaatgaagtgactatcgtcgaggatccagttactggtgacgtcacattcctgaccagtgagagcatctacgaggacgcagtcagcggggaccacgtcttccagctctttgtcggcgacttggatagagatctgccgaataacaacgtgagttacacgatcaacttcggagtgaaccctcgcattcgagacttcttcgaggtagaccttgtgactggctgggtgcgggtgcactaccccgggcccgacaagctcgaccgggacggcgacgagcccacgcaccggatccacttcagcatcttcgataacttcatgagcgaaggagagcccaatcgcaaccagatcagcggggaagctcttataattttacttgatgtgaacgacaacaagcccgagctgccttcaccggacagcttccccccgtggaccgtctctgaaagtgtagtcgagggcgtccggataccaccagaaatcttagcacccgaccgggatgaaccaggaacggacaactcccgagtggcgtacgacctcctgggagttaccccggagagagacatcgaagtaccccagctcttcaaaatcgagaccatagagaaagatctcggaataaaccagactgggatactagaaactgtcacgccattacaagggtattggggtacctatgagattcacataaaggcatttgatcacggagacccacgtcaagagtctgacgagaagtaccagttagtggtcagaccctacaacttccacgaacccacgtttgtatttccattagatggatctgccatcagactatcgagggaccgcgcgatcgtgagtggggagctgacggtagtcggcgctgcgcaggcgccgcttcagcgcatctctgccactgatgaagacgggctccacgctggaaccgtcagtttctcagtagtgggtgatgacgaggcgatgaattacttcgacgtgtggaacgacggagagaactctggcatgctggccctcaagcaggccttgccggacggcttccaagagttcaagctgacgatccgagcaacagatgccggcgacgagcccggccccaagagcaccgacagcaccgtcacagtggtgttcataccacaagtagagccccagttccccaccaacactcaagaagttgcttttattgagtttgaagcaggccggtcggagcgacacgagctgacggccgccgtagaccagaagaacatcctctgtgatattgattgctacactgtctactacaccatcattggtggtaacgcggcgggacacttcgcactggacggcaacgtgctgtacctggtgtcggagctggaccgcgcgcaggccgagcggcacacgctgcaggtggccgccagcaacgtgcccggcgtcaccaccgccgcgcccgcctccacactcaccgtcatcgtcactgtccgggaagcgaatcctcggccgcacttcgagagaaacctgtataccaccggaatgtccgccacagacacagacagcgagagacctctcctcacagtatcggcgacacactcggaaggcctacctatcacgtacgcgatagaccaggactccatggtactggacccaacgctggaacaggtccgggaaagtgccttctcgatgaaccctgagaccggagagttgatgaggatgatccagcccaatgccaatatgcatggcatgttcgagtttgatatcctggctactgatacagctggagcgacgggccagtctcacgtgaaggtgtacctgatttcatcccgcaacagagtctacttcaccttctacaactcacaggagtcggtccaggaacataggacctttatagcccagacattcacccgtgtatacagtatgacgtgcaacatcgaggacatcgtgcccgccaccgactccaacggccaatatctgactaccgaaactcatgtcacggcgcatttcatacgtgacgacttgcctgtagacgctgatgatgtccaggaattaatcgaggacacggagttgtttcgcgaactcagaacaactatgcttggtctgggcctgcaactcacgaacgtgcagtcgggactgccgccgtcggtggccggcgaagaccagatgctggccgtgtacatactggccggactggctggcgtgctggccctgctgtgcatcgtgctgctcatcactttcatcatcaggaaccgctcgctaaaccgacgcattgccgcgctatcggcgacaaagtacaactcggtggactcgaacctcaaccgcattggtctggccgcacccggcaccaacaaacacgccttcgagcccaaccccatatggaacgaaactattaaagcaccagactttgacgctattagtgagcagtccaatgattcggatctgattggcatagaagaccttcctcaattcaggaacgactactttccgccagaacaagagattgacatgaatagcaacgatattggataccctgaaatggatgcccgcaacccactacccaaccatgagaacaactttgggtacagcaacgctcccttcaatcctgatttcactaattcacagtcacggagataa

SEQ ID NO: 65 - DNA, 1617 bp, Agrotis ipsilon
atgaggtcgttagtcctactttttgtaacattatgtgcgggcgcggtgagagccgaccgctaccacccggcggacccactcggtcgcgcggctgccgctaaccgcgctgaaaccgactccaccttctggacaggcgaagcgcaggccgccatcaaagcgcgcctcgcgcacaaggagagcgtgaagaaggcgcgcaacgtggtcatgttcctgggcgacggcatgtccgtgcccacactggcggccgcgcgcacgctgcttggtcagcgacgaggagaaaccggcgaggaggctaagatgcactttgagactttccctacggttgggatggttaagacgtactgcgcgaacgcacagatagcagactcagcgtgcactgccaccgcgtatttatgtggagtcaagactacgtatggtgctattggagtgaacgcagccgtgcaacgcggcaactgcgaggcgtccacgaacaggaacacgcacgtgcagtccatcgccgagtgggcgctggcggacggccgcgacgcaggtatcgtgacaacgacgcgcatcacgcacgcgtcgccgtccggcgtgtacgccaaggtagcggatcgcgactgggagtacaacgagcaggtggagaaagagggctacgacacggagcgctgccccgacatcgcactgcagctcgtgcacagccatcccggcaacaagctcaaggttattttaggtggtggtagacgaagccttttaccaacaggcttcctcgacgaagaaggatccgaaggtagacggacagacaaccgtaacttaatagatgagtggaagcaagacaaaaagaaccgtgaagttagctatcagtatgtatggaaccgcgagcaactcttgcaagcaaatgataccttgcccgagtaccttttgggattgtttgagaacaaccattgtcaatataatttaaaagcaaatttggaaacagagcccacactgacagagatgacggaggtggctattcgctctttaagtcgtaacgagaagggtttcttcttgttcgttgagggaggccgcattgaccacgcgcatcacgacaacctcgtggagctggcgctcgacgagacaatagagatggacaaggccgtggcgcgcgccgcagagatgctgtccgaggaagactcgctcattgtggtgacagcagaccactcacacgtcatggccttcaatgggtactctggacgtggccatgacattctcggtccctccagagacaaaggaaatgactcgatgccctacatgacactgtcatacacgaacggacccggtttccgtgctcatgtcgatggcgttcgacctaatgtaacagatgaggacaatttcagacaactagattgggagtctcatgtcgatgtacatcttgaatgggagacgcacagcggcgacgacgtcgcagtgttcgctcgcgggccgcaccactccatgttcacggggctgtacgagcagagtcagctgccgcacctcatggcgtacgccgcctgcatcggacccggagaacacgcctgcagcggctctgcgcaagtggtgactattcctgcaacatttataacaatctttgtacttctagcctctcattttatgcagtga

SEQ ID NO: 66 - DNA, 1617 bp, Agrotis ipsilon
atgaggtcgttagtcctactttttgtaacattatgtgcgggcgcggtgagagccgaccgctaccacccggcggacccactcggtcgcgcrgctgccgctaaccgcgctgaaaccgactccaccttctggacaggcgaagcgcaggccgccatcaaagcgcgcctcgcgcacaaggagagcgtgaagaaggcgcgcaacgtggtcatgttcctgggcgacggcatgtccgtgcccacactggcggccgcgcgcacgctgcttggtcagcgacgaggagacaccggcgaggaggctaagatgcactttgagactttccctacggttgggatggttaagacgtactgcgcgaacgcacagatagcagactcagcgtgcactgccaccgcgtatttatgtggagtcaagactacgtatggtgctattggagtgaacgcagccgtgcaacgcggcaactgcgaggcgtccacgaacaggaacacgcacgtgcagtccatcgccgagtgggcgctggcggacggccgcgacgcaggtatcgtgacaacgacgcgcatcacgcacgcgtcgccgtccggcgtttacgccaaggtagcggatcgcgactgggagtacaacgagcaggtggagaaagagggctacgacacggagcgctgccccgacatcgcactgcagctcgtgcacagccatcccggcaacaagctcaaggttattttaggtggtggtagacgaagccttttaccaacaggcttcctcgacgaagaaggatccgaaggtagacggacagacaaccgtaacttaatagatgagtggaagcaagacaaaaaggaccgtgaagttagctatcagtatgtatggaaccgcgagcaactcttgcaagccaatgataccttgcccgagtaccttttgggattgtttgagaacaaccattgtcaatataatttaaaagcaaatttggaaacagagcccacactgacagagatgacggaggtggctattcgctctttaagtcgtaacgagaagggtttcttcttgttcgtggagggaggccgcattgaccacgcgcatcacgacaacctcgtggagctggcgctcgacgagacactagagatggacaaggccgtggcgcgcgccgcagagatgctgtccgaggaagactcgctcattgtggtgacagcagaccactcacacgtcatggccttcaatgggtactctggacgtggccatgacattctcggtccctccagagacaaaggaaatgactcgatgccctacatgacactgtcatacacgaacggacccggtttccgtgctcatgtcgatggcgttcgacctaatgtaacagatgaggacaatttcagacaactagattgggagtctcatgtcgatgtacatcttgaatgggagacgcacggcggcgacgacgtggcagtgttcgctcgcgggccgcaccactccatgttcacggggctgtacgagcagagtcagctgccgcacctcatggcgtacgccgcctgcatcggacccggagaacacgcctgcagcggctctgcgcaagtggcggctattcctgcaacatttataacaatctttgtacttctagcctctcattttatgcagtga

SEQ ID NO: 67 - DNA, 5202 bp, Spodoptera frugiperda
atggcggtcgatgtgcgaatactgacagcaacattgctggtactcaccactgctacagcacagcgagatcgatgtggctacatggtagaaatacccagaccagacaggcctgacttcccacctcaaaattttgacggtttaacatgggctcagcagccactattaccagctgaggatcgagaagaggtctgcctcaatgactatgaacctgatccctggagcaacaaccatggtgaccagagaatttacatggaggaggagatcgaaggtcccgtagtcattgcgaaaattaactaccaaggaaacacccctcctcaaataagattaccttttcgtgttggtgcagcccacatgcttggagcagaaattcgtgaatatcctgacgcaactggagactggtatcttgtaattactcaaaggcaggactatgaaactcctgatatgcagagatacacgttcgatgtgagtgtggaaggccagtcgctggttgtaacggtgaggctggatattgtgaacatcgacgacaatgcgcccatcattgagatgttagagccttgcaacttaccggaacttgttgaaccccatgttacagaatgtaaatatatcgtgtccgacgcagacggtctgatcagtacaagtgttatgagttatcatatagacagcgagagaggagacgaaaaagtattcgaactgatcagaaaagattatccgggcgattggacgaaggtgtatatggttcttgaattgaaaaaatctcttgattacgaagagaatcctctacacatattcagagtcacggcttctgattccttaccaaacaataggaccgtggtcatgatggttgaagtagagaacgtggaacatagaaatcctcggtggatggagatctttgctgtgcaacagtttgatgaaaaacaggcgaaatcgttcacagtgcgagctattgatggcgacacgggaatcaataaacctatattctatcgtatagaaactgaagatgaagacaaagagttcttcagcattgagaacataggggaaggcagagacggtgccagattccacgtggctcctatagacagagactacctgaaaagggatatgtttcatataagaataattgcatataaacaaggtgataatgacaaagaaggtgaatcatcgttcgagacctcagcaaatgtgacgattataattaacgatataaatgatcagaggccagaacccttccataaagaatacacgatctccataatggaagaaactgcgatgaccttagatttgcaagagtttggtttccatgaccgtgacattggtccccacgctcagtacgacgttcacttagagagtatacagccagagggggcccataccgctttctacatcgcccctgaagaaggttaccaggcccagtctttcaccataggtactagaatccataacatgttggattatgaagatgacgactacagaccaggaataaagctaaaggcagtagcaattgacagacacgataacaatcacattggggaagcaattattaacattaaccttatcaattggaatgatgagctacctatattcgacgaggacgcctacaacgtgacatttgaggagacggtcggtgatggcttccacattggtaaataccgggctaaagacagagacatcggtgacatagtcgagcactcgatattgggcaacgctgcaaacttcctgagaattgacatagatactggagatgtgtacgtgtcacgggacgattactttgattatcaaagacagaacgaaatcatagttcagattctggctgttgatacactaggtttacctcagaacagggctaccacacagctcacgatatttttggaagacatcaacaacacgccacctatactgcgactgccacgttccagtccaagtgtagaagagaacgttgaagtcgggcacccgattaccgaggggctaacggcgacagacccagacaccacagccgatttacacttcgagatcgattgggacaattcttacgctacgaagcagggcaccaatggacccaacactgcagactaccacggatgcgtagaaatcctgacggtatacccagatcctgacaatcacgggagagctgagggtcacttggtggcacgtgaggtcagtgatggcgtgaccatcgattacgagaagtttgaggtgctgtacctcgtcgtcagggtgatagatcgcaacactgtcattggccctgattatgacgaagcaatgctgacggtgacgataatcgatatgaacgacaactggccgatatgggccgacaacacgctgcagcagacactgcgcgtgcgcgagatggccgacgaaggagtcatcgtcggtacactgctcgccaccgacttggatggccctctctacaaccgagtccgctacaccatggtccccatcaaggacactcctgatgacctaatagcgatcaactacgtcaccggtcagctgactgtgaacaaggggcaagcaattgacgcagatgatccacctcgcttctacctgtattacaaggtcactgccagcgataagtgctctcttgacgagttcttccctgtgtgcccacctgaccccacttactggaataccgagggagagatagcgatcgcgataaccgatacgaacaacaaaattccacgcgcggaaacagatatgttccctagtgaaaagcgcatctatgagaacacacccaatggtaccaagatcacgacgatcatcgctagtgaccaggacagagatcgaccaaataacgcgctgacgtacagaatcaactacgcattcaaccacaggctggagaacttcttcgcagtggaccctgatactggtgaactgtttgtccacttcaccactagcgaagtgttggacagagacggagaggaaccggagcataggatcatcttcaccatcgtcgataacttggaaggcgctggagatggcaatcagaacacaatctccacggaggtgcgtgttatactgcttgatataaacgacaataagccggaactaccaattcctgatggcgaattttggaccgtttccgaaggtgaagtggagggaaaacgcattccaccagagattcacgcacacgacagagatgaaccattcaacgacaactctcgcgtgggatatgaaattcgatcgatcaaattgatcaatagagacatcgagcttcctcaagatccattcaaaataataacgattgatgatctcgatacctggaaattcgttggagagttggagactaccatggaccttagaggatactggggaacctatgatgtcgagatacgtgcgtttgaccacggtttcccgatgctggattcattcgagacctaccaactaaccgtcaggccatacaacttccattcaccggtgtttgtgttcccaactcctggctcaaccatcaggctttctagggagcgtgctatagtcaatggtatgctggctctggctaatatcgcgagcggagagttcctcgacagactctctgccactgatgaagatgggctacacgcaggcagagtaactttctccatagctggaaacgatgaagctgcggaatatttcaatgtgttgaacgacggtgacaactcagcaatgctcacgctgaagcaagcattgcccgctggcgtccagcagtttgagttggttattcgggccacggacggcgggacggagccgggacctaggagtaccgactgctccgtcactgtggtgtttgtgatgacgcagggagaccccgtgttcgacgacaacgcagcttctgtccgcttcgttgaaaaggaagctggtatgtcggaaaagtttcagctgcctcaggccgatgaccccaaaaactacaggtgtatggacgactgccataccatctactactctatcgttgatggcaacgatggtgaccacttcgccgtggagccggagactaacgtgatctatttgctgaagccgctggaccgcagccaacaggagcagtacagggtcgtggtggcggcttccaacacgcctggcggcacctccaccttgtcctcctcactcctcaccgtcaccatcggcgttcgagaagcaaaccctagaccgatcttcgaaagtgaattttacacagctggcgtcttacacaccgatagcatacacaaggagctcgtttacctggcggcaaaacattcagaagggcttcctatcgtctactcgatagatcaagaaaccatgaaaatagacgagtcgttgcaaacagttgtggaggacgccttcgacattaactctgcaaccggagtcatatcgctgaacttccagccaacatctgtcatgcacggcagtttcgacttcgaggtggtggctagtgacacgcgtggagcgagtgatcgagcaaaagtgtcaatttacatgatatcgactcgcgttagagtagccttcctgttctacaacacggaagctgaagttaacgagagaagaaatttcattgcacaaacgttcgccaacgcgtttggtatgacatgtaacatagacagcgtgctgccggctaccgacgccaacggcgtgattcgcgaggggtacacagaactccaggctcacttcatacgagacgaccagccggtgccagccgactatattgagggattatttacggaactcaatacattgcgtgacatcagagaggtactgagtactcagcaattgacgctactggactttgcggcgggagggtcggcagtgctgcccggcggagagtacgcgctagcggtgtacatcctcgccggcatcgcagcgttactcgccgtcatctgtctcgctctcctcatcgctttcttcattaggaaccgaacactgaaccggcgcatcgaagccctcacaatcaaagatgttcctacggacatcgagccaaaccacgcgtcagtagcagtgctaaacattaacaagcacacagaacctggttccaatcccttctataacccggatgttaagacacctaacttcgacactataagcgaagtatccgatgacctgcttgatgtcgaagacttggaacagtttggaaaggattacttcccacccgaaaacgaaattgagagcctgaattttgcacgtaaccccatagcgacacacgggaacaactttggcgtaaactcaagcccctccaacccagagttctccaactcccagtttagaagt

SEQ ID NO: 68 - DNA, 2952 bp, Spodoptera frugiperda
atgcgatttaccggtgtcatagttctggcgctagtcgctcttgcatgggcagatggacccttgcccttagacactgaaagagtgaataccctcaaccctgcgagtgatagttaccgtctacctgaggacttggaccctatcagttacgatatagaagtaactccatacttcacggcagaaaccactccacctggaaagacacagttcactttcgatggtaccgtcaccattgttttcaaggttctcaaacccaatctaaactcttttgtcatacatgaaaatgtaagagaaattacgggagttagaatattcaaggatgagaataatgaaatggttaatgtgctatcacacgaaagagaccgagtgcatcaatttttaaaaattaatctggctacaggcaccactttggaagtgggagctaaatacaggctgttggttatctatgtaggtaacatcaacgagactcctctctcccgaggtgtattcagaggaaactacaaagatgaaaaaggagttacacgctggtacctggccactcatcttcagcccactcactcaaggcaggccttccctagcttcgacgagcctggattcaagtccaccttcaaaattaccatcaacaggccaactagcttcactgaatcattctccaacatgaagttgctacattcaatacctaacggagagcgcaccaaagagatcttcgaagagaccccaagaatgtcggcttacttggtgacattccacgtcagtgacggatttaaagtgattgctgacaataatgacgctgaaaggtcttacagaatccttgcaagacctaacgccgagggccaaggagaatatgctttggagataggaacacctattactaactggctcagtgattatttgaaaattgattactattccatggctacaggcattaaaaatgaccagatagcctcaccttactgggcttcaggggctactgaaaactggggattggtgacttacagggaacttcgtcttctctacgaggagggggaaacaaatgctgctgacaagctttctatcggtaccattactgctcacgaacttgcccacaaatggttcggtaacctgatcacatgcagatggtgggacaacgtctggatcaacgagggattcgccagttacttcgagtacttcgctatggatggcgcataccccgatttggaattagccgatcagttcaacattatgtatcttcaaagtgcattatcaatggactcgtcaactaataccagagctttgcagcacaccgtcaatagtcccagtgaagtcaccagccatttcactgacattagctactctaaaggagcttctttcctccttatgttgaagcatttggtctctaaagaaactttccggcaggctttatactactttttggaggacagaaaatacgaacacgctttcccgtctcaccttttcgatgcttttgaaaaggcagtagcagaaaaatcgccagagggcaacgctctggatatcaaatcgttcatgtcctactgggtctttgaacaaggataccctgtcctcgatgttaaagtaaacagccaagctggtactatcgaacttgaacaggaccgattcttcattagtccgtccgcgactcctacacagcaagtttggcctctgccaatcacttacacgactcaaagcagcccgaactggaacaatctcgatcccgtcaaagtgatgacaacgaaaactgacactctccagaatgttccaaccgatggctgggtcatcttcaatgtgcaacaaaagaatatctacagagtgaactacgacacggaaaactggttgaaactcgcagcacaacttcaaaccgatcacaacgctattcatcatttgaacagagctcagattgtggacgatgtgttcgctctcatgcgttctgaaaggctgtcattacaagttggcttccaagttcttcagttcttgaagaaagacacgagcttctacgtgtggtacccagcaatatccggttttaactggataaggaatagactcttgcatactgaacagctccctatttttgacaaactcctgttcagctacctgactaacgtcattgaggatgttggtttcgatgtggatcccaacgagcatatcacaaggactctgaacagattctacatcctcaacttcgcttgcaacatcggtcacgaagagtgcataaacaactctgttaacaaatttaggtcttacagtagcggcgatgtacttagtgtcaatcccaacgtgagacgtcacaccttctgtgagggtctccgagctggtggctatgaagaatggagcttcttattcaagcgtcggcaggagtctaacaaccaggcagatgaggtagcaatgttgagagccttgggatgtactacgaacaatgaagccagaaacgaatacctgaaaaatatcttaactgaagacgttaaggctcaagatcgagtgaacgccttcactttcttctacatgggagatgcatccaacgctaaattcgccataccattcattaaggaaaatataaaagacattgaaaaagcggttgttctgccagcgtggttcagtaatatattcagcaacattgctggctacttagatgaagaaggcttggaagaatactcaactatgctgacatcgctagaagcagaatatccgtctgcattcactgctggtaacaatgctataaattcagctagagcgaatatcgcgtggggcaatgaaaaagttgcacagataacagatatagctaatggacaactctctacaactactacaactacaactactacaaccacatcaacggaggcgcctccttcctcttcaagcgaggaaccgacgactactccagaacctgccccaggctccgcctcagttgcattcccagccaccataatgctcttatggacagcactagccattatgctacaatag

SEQ ID NO: 69 - DNA, 2811 bp, Spodoptera frugiperda
atgtgtcgtttactactgacagtagcattaacatgcgtgctatacacaagcgtatacacaacagacacaaactaccgactgaacacgccactaataccatcagagtaccagctcttgataacaccatacttcgagactggagacgcaagacaattcacctttgatggcactgttagtatacaacttacaccaagttccagcacgaacgaaatcaaattgcactctgaagacctaatcttcactgcccaagatgttgctgtagctgtatttagtactggggttacaatacctctaaacgctgccaaccccatagagtttaacaaaaactacacttttgcttacatcaatttgtccgagaacttgcaaactggagtacaatatattctgcagatcaagtaccaaggacctattagaacagatctgaatggtttctacaggaactactatttccagaatggtgtcaaaaaatggctcggtgcaactcaaatggaaccaactcacgcaaggaaggtgttcccttgcttcgatgagccggaacttaaagcgacattcgtaattgggattgatcgtcctgccgactaccagccttctttatccaatactgatatagaacgaagagaactattggccaatggctacatacgagaagtattctaccgaaccccaagaatgtcaacctacctggttgctttcctggtctccgagtttgaagcagctgcctccagcctcgatgggacaaatgagtttggaatctatacccgacctgacgcaaagaatcagagtgactatgcttttgattttggaaagaaagttgtcgacgctttgagcagctattttggcattaactactactctacgaacagtcatttgaggcttgaccatgttgcattgatagattttagagccggtgctatggaaaattggggtctcattaaatatagagaatccctgcttctgtacgtccctggtcaatcgaccccgtacttcaaataccgagtggcacagatcatggcacatgagaccacacacatgtggtttggaaacctagtgacctgtcattggtggagcaacacctggctgaatgagggctttgctaattacttccaggactacatcacttcgtttgtggatccttccgtcggagcagggaaccagttagtcataggatctgtctacagtgcatatgacgctgacaacagcccaacttcaccaccaatcacgaacaacgccgtcaactctcctgcagaaatcagcggccatttcggaaccatcacctatcagaaagctggttctgtaatccgtatgatgcatcaccttattcaggacgaggcattcaaatatggacttaattattacttgactattaactcatttaatcctggttacccagataaattgtatgaaggtcttcatcaaggagtgcagagatataattcattgtcatccttccctggtcataacatctctgaagtcatgaattcttggatctctcaggctggccacccggttgtaaaagtgacaattgattacagtaccaacgttgttactttgacccaaaaacgctactacgtgaattcttccatatcatccaatgagacgtacaagattcctatcacgtataccacaggaatggctccagactttgagaacactaggccagtgttcatcatggaagaccagacatttacactcacgatctccaaccttagtaatgaacatagctgggtcatcttcaatctgcaagaaacaggtttatacagagtcaactatgacgaccacgcatggagtattataatatcagcattgaaaggagaccacagcgcagtcatacatccactgaatcgtgctaagattataaacgatctcttcgccctggtttacgcggatgaagtctcgttttcaacactctccagtgctttagactacctaccatcagaaccggagtacccaggctggttcgcagcgttgagaggatttagcaaaatatggcatttctacttaggagacaatgaagtgctaccacatgttgagcatttcatactgcaccacttggagtctggtataacaagattaggttacgaagaaaggtccacggacagtcttgaagaccagaggaatcgcatgcagattctggagtttgcttgcaaattggagtatagtggatgtgtcgagaggactgtagcgttattcagggctttgaaggaaaatggcactgaagttgcagcaagtttgcgtccagtggtgtactgcactggtcttcgccatggatctgccgaagactacgacttcctctggaaccgcatggtgaacaccaacctggctaatgaggtctgggttattggagatgctcttgggtgtacttctgatgaaaacagaatcagaagtttcttgacatcaatgacagtggaaaatagtcccataaagactcaagacttgacagtcccattggcgagtgtactccggacgtatggtaaccgacacatcgtaatggatgctttgaaaactaactacacattgtggagctctatatacccatcaatggatactgtgttgaatacagttgcatcagctcttcacactgaagctgatttcaatgagttcgaatccttcctgtcggagtgcactgtctgcacagaagctgcgaagacatctggccgtaatgctctagtgcaggcacgagccatcactgattgggcaaacagccacaaggcagacatattgaaagtgatcagaagtaattccatcatggcgtctccatctgtcattgtgatgctattagggttggccatactcatttttaaagagttttaa

SEQ ID NO: 70 - DNA, 2916 bp, Spodoptera frugiperda
atgtatttactgacactacttgccctcatcgggtcggcgttcgccgtacccgtgacagaactgtcaaagcagagccatgctgagaagtacgttctacccaggactgtgatgccgtcattctacgacgtcgttctattccttgaccccgacaatgaagcctacttcgaaggatcagttgacatcagaatcatrcccgtagtagccacaaatgaaatagttcttcaagctatggagatgacaattgattcaaataatattgaagtgtttactgacatccagcctgaaaataatttatacagttcacacacgttagctactgatgacacacatttattcaagatccagttgaaggaaacattgccggctgctcgtgtacacaccattagaatcaaaaacttcagaggccaatacgcgactaatatgtttggtatttacgtgtccacatacaccaatgaagcgggccagactgaaaaactaattacgtcacaactgcagcctacttttgcccgccgtgcgttcccgtgcttcgacgagccttccttcaaggccaggttcaggaccaccatctacgctcgaccatcttacagcgtggtcgagagtaacatgcctttgagtccccccgaggatttgcgcaaagaaaacgttcagggatggaataagtacgagttccaagacactccattgatgtccacatacctactggcttacctggtctcaaactttgagaaaattgacaactcggtcgagcccatctttracgttccattcaaagtattttcaaggcctggcatgcagaaacctgcagaatttgccctagagttcggacagaagaacatggtagcgctacaaaattacgttgagtttgactatgtattacccaaactggacaaagctgctgttcctgattttgctgctggtgctatggaaaactgggggctggtcatttacagagaagtggctcttctggtgactgatggagtgacaactactgctacaaagcaaaatgttggtagaatcatctgccacgagaatgttcaccaatggttcggcaatgaagtcagccctgactcttggacttacacttggctgaacgagggcttcgctaacttctttgaaaacttcgctactgatatggtgctggatgaatggcgtatgatggatcagtttgtactggctctacagaacgtcttccagtctgacgctgtcctcatggtgaaccccatgacccacgctgtctactctccctccgaagtcatatcaactttcaatgctgtcgcctaccagaaatctggttccgtgattcgtatgatgcagcatttcctcacaccagaagtattccgcaagggattggttatctacatcaaaaaacacacccgtcaggcagtccttccctctcacctgtacgctgctctccagcaggctttggatgagtctgatcactctattccattccccttaatcgaagtgatgactcgatgggaaaaccagggtggtttccctgtcctgactgttacacgaagcgctccaactgcccagtcaatccatgtggcacaggaacgttacctcacagacaataagctgacagctccagaccgctggcacgtacccatcaactgggtcctatccacaaaccctgatttcacagacaccaaaccacaaggttgggtgcgtcctaccttccctgctctttccttcgacatccccggtctggcacaagctgactggtacatcctcaacaaacaacagactggttactatagagtgaactacgaagtttcgaactgggttgcattggcgagcgcattgggagaaaaccacgatgtaatccatgttctgaaccgtgccaaccttttggacgacgcgttcaacctggccagaaatggacgcctgaattaccaagttgccttgagcttatccaggtacttggtcaaggaggaggactacattccatggggtgccgtcaatccttcaatcacatatctcgactcagtcctcactggatcaagcgtttacaaattattccaacaatacattctacagttgactgccccgttgtacgagaaacttggatttatagcagataatgatgaggaacacgtgactgcctaccataggaatattatcctggatctgaactgccgtcacggaaatgaagcgtgcaccagtactgctcagacactcctcgaaaatttcaaggacaatccagttgcacataatttgaatcctgacattcaaaatctggtttactgtgctggcctccgtggaggcagtgtggacaatttcaacttcctttgggaaagatacttgaacagccaagaccacagcgagcagtccattctgctgaatgctcttggatgcacctccaatgcggaacgtcgtgaattctacatgaaccaggttattagcgactcgtctcctgtcagagaacaggacaggcacacaatcttggtgtctgtcaccaacgccagtcctgagagcacaaatgccgctcttgacttcgttgttgagcattttgcggctatccaaccaagagtgcaaggtttgactggcaccaccaacatcctgaatgcgtttgccagaagacttacaactcaagaacattccgcgaagatcgatgagctgcacacacgccatcaagccattttcaccgctggagagctggcttcaatcgctggaatcagagacaatattgctgcttccattacttggaataacgaatacgcacaagtggtcgacgactggttccaagacaattacggtgagggcagtggcggcgacactgacgatagcggtgtagagggcagcggtgaggatggagatggtggtggcgaagaccccgctggtggcggtgctgccagcctggtatcaggcctagtaatcttaatttcgtttgtagcaacattcttcaatcattaa

SEQ ID NO: 71 - DNA, 3030 bp, Spodoptera frugiperda
atggtagcgataaaacttatagttttatctttagcttgccttagtgcagctgccgtatctcctattgagccagccaagaggaatactatatttgcagatgaacgttttgaaggagaagtcttcgaaaatgtcgacgcttttgacaacattgaactgactcctagtaacatcggcatttcaccctacagactgcccactacaactgcaccaataaaatatgatgtgcattggaatttcgaattcacaaatcaaaggatctattctggcacagttgtgataacgcttgtagcaaaacaaccaaatgttaaccaaattgtcatccacagtagtcacactgtgaacactggtccggagcttaagctgggaacacaggtgatccctattacggcttcagctaaggaagaataccatttctacattgttacacttaatgatggccaggtcttagaatataatgaagcacaacccgttgaatatacgctaaaaatcgactttagtgcagcttttcgaacagacatgtatggtatctatgaaagttggtttagaaatacacctaacgaagaagtgcagtggatggctaccactcagttccaagcaactgcagctcgttttgcatttccttgttacgatgaacctagtttcaaagctaaattcaatgttaaaattacaacgccagcagactattcgagttggttctgcactactgccaaaccctcatcacctccagctacacctacccaatttgtgaccgtcgagtataacgaaactccagtaatgtcgacttatcttctggctctgattgtctctaaacaatataagagtatcaataatgagaatccagcaaagttccacgaagttatagcaaggcagggtgcaatcgatgccaagcaaggagaatacgctttgaagactggtcaagcgcttctagataagatgagtgagatcacacaatatgacttttatgatcaacatgccactcttaagatgactcaggccgctattcccgattttggagctggagctatggagaattggggattgttgacttacagggaagcgtatctactgtctgatccattggaaaccagcagtcagttccaacagatcatcgcttacattctttcacacgaaatcgctcacatgtggtatggtaatcttgtcacaaacgactggtgggacgttctatggctgaatgaaggttttgcaagatactaccagtacttcttgactaatgaagtggaggggatgggttttgacattcgtttcgttcctgagcaagtacacacggctttgctatctgactcttctaacaaccctcatcccctgaccaaccctggtgttggaagtccccgatcagtcagtgctatgttctcgacactcacttacaacaaaggtgcagcagtcatcagaatgacagaacatctccttactaaacaagttcatgaccaaggtctcgcacaatatttgaaaactaatcaattcaaaacagctaaacctatagatctgtttaatgctctgagagacgcaggaatgcaacatggcgcttttaacaactatggcccaacattcgattttgtggaatactacaagagttggactgaacaggccggacaccccgtcctaaacgttgatattaaccatacaacggggcaaatgactattcaacagcgccgttttaacatcaacactgggtattcccttcaaaatacgttatatgtcattcctgttacttttacaagtgaatttgactataatttccaaaacacgaaaccaacacacattattaaagacgccgtcactgtcattgaccgcgacgcttatggagattactggactatctttaatattcaacaaacaggtttctatagagtcaactatgatgagtacacgtggaatttaatcgccttggccttaagaggagatcagtggaatagtaacatacacgagttaaacaaagctcagattgtaaatgacgtgttctcatttgctcgtgccggtcttatgaagtatgaccgtgcactgcatatcctggcattcctcgctagagaaaccgattacgctccatgggctgcggctattactggcttcaattggcttagaaacagactcgctggacacccgttggaagcaaatctcaataatttgattcgtgcttgggcaaagaaagcgatggacgaacttacttatgaaccggctagtgacgctacatttatggacagatacttccgattccaacttgctccattgatgtgcaacgtgggagatacggaatgcagagagaaagccaagacattctttgacggtcttaaagcgaccccttcagtgtctgtggacagagacaaccgtaactgggtctactgcaatggtcttcgccaaggtactccagctgacttcgatttcttgtgggacagattctcaaaagagaatctctacacagagaaaattgtacttcttcagattcttggttgcactcctcacaaggagtcgcttgaaaaatacttaaacgcgatccttcgagcacctaataccgtccgtcctcaagattacaacaccgctatcaattcagctgtctcaggcaatgaagccaatacacagattgtcctcgattatttcaaggtgtccgacaacttgcaatctctgcgtacagcatacaataatgatttgaggactccactgtcttacatcagctccagattgaggaccgcagcccaagtcgaggatttcaaaacatgggtgaatggtcagacaaacttagaatatcgggacgacatcatcgcgggagcggacgacacacttgaaagctttaaattcgtcgaaagtatctctagttatttggaggattactttactggcacagatgaccccatttcgaccagcaccatccttccgaccactgcggggcccacaagcacagtgactgcgccatctttagtgcaaccaaccaccccagaccttcctgcctccgctgtcacaagcgtcgtatccatcttccttttaaccttagccggtatagctcattttattctataa

SEQ ID NO: 72 - DNA, 1626 bp, Spodoptera frugiperda
atgaggtcgctactgacttacctagtggccgccgtgatggtggcggcatgtgtccgcggggaccggtaccaccccgcggaccccggcagcagagctgacaccgttgtgaaccgtgccgagacctcagccaactactgggcccaagaagcgcaggctgcaatcaatgcccggctggcgcacaaggagagcgtgaagaaggcgcgcaacgtggtcatgttcctgggcgacggcatgtccgtgcccacgctcgccgccgcgcggacgctgctcggccagcgccgcgggcacaccggcgaggaggataaactgcattttgaaacattccccaccgttggattgactaagacgtattgcgtgaacgctcagatcccagactccgcgtgcactgctactgcgtacttatgcggtgtcaaaacaacttacggagctattggagtgaatgcggaggtgccacggaaaggctgcgaggcgtccaccgacaccagccgacacgtggagtccatcgccgagtgggcgctggccgacggccgcgacgctggtatcgtgacgacgacgcgcatcacccacgcgtcgccggccggcgtgtacgccaaggtggcggaccgcaactgggagcacaaccaggcggtggagaacgatggcttcgacacggacaagtgcccggatatcgcactgcagctcgtgcataagcaccccgggaataaactcaaggttattttaggcggaggaagactaaactttttgccaaatgatgtgaaagacgaagaaggagtatatggaaaccgaacagacacccgcaacctcatcgaagaatgggcacaagacaaggaagatcgtaaagttactcataaatatgtttggaatcgtgagcagctgatgagtcttaaagatgatcttcctgagtaccttttaggacttttcgaaagtaatcatcttcagtacaacatgcaggcagatcctaatactgagcccacgttgactgagctaactgagatagcaatcaagtcgctaagtagaaacgagaaaggttttttcctgttcgtggaaggcggtcgtatcgaccacgcacaccatcgcaactgggtagagctagcgctggacgagacgctggagatggacaaggccgtcgcgcgcgccgccgagctgctctccgaggacgactcgctcattgtggtcacagcagaccactcccacgtcatggcttacaatggctactcggcccgtggacatgacatcctcggcccttccagagacttggacctggacggagtgccttacatgacgctgtcgtacaccaacgggcccggcttccgttcgcatatgaacggtatacgccccgatgtcaccgctgaagacgatttcagaaaagacggatggttggctcacgtagatgttccgctgatagacgagacgcacggtggggacgacgtggcggtgttcgcgcgcgggccgcaccactccatgttcacggggctgtacgagcagagccagctgccgcacctcatggcgtacgccgcctgcatcggccccggcagacacgcctgcagcggcgccgcgcatgcgctggcccagcctgtgctgctgctctctctccttgtactgctcacttcactattccaacaatga

SEQ ID NO: 73 - DNA, 1626 bp, Spodoptera frugiperda
atgaggtcgctactgacttacctagtggccgccgtggtggtggcggcgtgtgtccgcggggaccggtaccaccccgcggaccccggcagcagagctgacaccgttgtgaaccgtgccgagacctcagccaactactgggcccaagaagcgcaggctgcaatcaatgcccggctggcgcacaaggagagcgtgaagaaggcgcgcaacgtggtcatgttcctgggcgacggcatgtccgtgcccacgctcgccgccgcgcggacgctgctcggccagcgccgcgggcacaccggcgaggaggataaactgcattttgaaacattccccaccgttggattgactaagacatactgtgtcaacgcgcaagtgccagactcggcgtgcactgccaccgcgtacttgtgtggtgtcaagaccaacaacggagtcatcggcctgaacgcggaggtggcgcgcggcgactgcgaggcgtccaccgacgccggccgccacgtggagtccatcgccgagtgggcgctggccgacggccgcgacgtcgggatcgtgaccacgacgcgcgtcacgcacgcgtcgcccgcgggcgtgtatgccaagatagccaaccgcacctgggagtacgacctcagcgtggcgctgaccggctccgaccccgagcgctgccccgacatcgcgtaccagctggtgcacaaccacccgggcaacaagttcaaggtaatactaggcggaggacgacgcaattttgtgcccgacaatgtcctcgacgacgagcaaaggtatggcagacggacggacaaccgccatttgattaatgaatggaacaaagataaggaagatcgaggagtcagccacaaatacgtttggaatcgtgaacagctaatgagtctcaaagatgatctgccggagtacattttgggtttatttcatagatctcacttgccatatcacatgcaatcaaactcagctagagatcctactctaaccgaaatgacggagatagcaatccagtcccttagtagaaacgagaagggcttcttcttgtttgtggaaggcggtcgcatcgaccacgcgcaccacgacaacttcgcagagctagcgctggacgagacgctggagatggacaaggccgtcgcgcgcgccgccgagctgctctccgaggacgactcgctcattgtggtcacagcagaccacgcccacgtcatggcttacaatggatactcggcccgtggacatgacatcctcggcccttccagagacttggacctggacggagtgccttacatgacgctgtcgtacaccaacgggccyggcttccgtccacatgtgaacggtatacgccccgatgtcaccgctgagaacgattacgaaaaattagagtggcgtgcacacgtagatgtgccacgggactcggagacgcacggcggggacgacgtggcggtgttcgcgcgcgggccgcaccactccatgttcacggggctgtacgagcagagccagctgccgcacctcatggcgtacgccgcctgcatcggccccggcagacacgcctgcagcggcgccgcgcatgcgctggcccagcctgtgctgctgctctctctccttgtactgctcacttcactattccaacaatga

SEQ ID NO: 74 - DNA, 5151 bp, Ostrinia nubilalis
atgggggttgagaggttcttcccagcagtgctactggtctctttagcctctgccgcactagccaaccaacgatgttcgtacattatcgcaataccaagaccggagactccggaactgccgcctattgattacgaaggaaaatcatggagtgaacagcctctaatacccggcccgacccgagaggaagtatgtatggagaacttcttaccggatcaaatgattcaggtcatatacatggaggaagaaatcgaaggagacgtcatcattgcgaagcttaactatcaagggtccaacacgccggtgctgtcgattatgtcaggccagcccagagcccagctgggccctgagtttcgacagaatgaagcagacggccaatggagccttgttattacgcaaagacaagactacgagacagcaaccatgcagagctatgtgttctcaatccaagtggagggtgaatcacaggccgtactggtggcgctggagatagtcaacatcgacgacaatccgcccatcctgcaagtggtcagcgcctgcgtaattccagaacatggcgaggctagactgaccgactgcgtgtaccaagtgtcagaccgcgacggtgaaatcagcacccgcttcatgacgttccgtgtcgacagcagcagggctgcagatgaaagcatcttctacatggttggagaatacgaccccagcgactggttcaatatgaagatgactgtggggatcaattcgcccttgaacttcgagacaactcagcttcatatatttagcgtcacagcttctgactcgctaccgaacaaccacacggtcaccatgatggtgcaagtggagaacgtagagtctcggccccctcgctgggtggagatcttctcagtgcagcagtttgacgagaagactaatcagagcttctccctccgcgcgatagacggggacacgggaatcaatagggccatcaactataccctcatcagggatgacgctgacgacttcttttccctggaggtgattgaagacggagctattctgcacgtgactgagatcgaccgcgacaagcttgaaagagagcttttcaacctcaccatcgttgcttacaaatctactgacgctagctttgcaacagaggcccacattttcatcatcgtcaacgacgtcaatgatcagcgacccgagccgctgcataaagaatacagtattgatatcatggaggaaactccaatgactctaaacttcaatgaagaatttggattccatgatcgagatttgggtgaaaacgctcaatacacagtggaacttgaggacgtgttcccgccaggggcggcgtccgcattctacatcgcgccggggagcggctaccagaggcagaccttcatcatgggcaccataaaccacaccatgctggattacgaagatgtcatttttcagaacatcatcattaaggtcaaagcagtggacatgaacaacgctagccacgtgggcgaggcgctggtgtacgtgaacctgatcaactggaacgacgaacttcccatcttcgaggagagcagctactccgcgtcgtttaaggagaccgtcggcgccggcttcccggtggccacggtgctcgccctcgacagagacatcgacgacgtagtagtgcattcattgatgggcaacgctgttgactacctgttcatagatgaatcaacgggagagatcttcgtgagcatggacgatgccttcgactaccaccgacagaacactctatttgttcaggtgcgcgctgacgatactttgggcgacggcccacacaacacagtgaccacccagctggtgatagaactggaggatgtcaacaacactcctcccaccctacgcttgccccgttcgactccaagcgtcgaggagaacgttcccgaaggatacgagatatcccgggaaatcactgctaccgacccggacaccagcgcctacctgtggttcgagatcgactgggactccacctgggccaccaagcagggcagagagaccaaccctactgaatacgtcgggtgtatagttatcgaaacgatataccccaccgagggcaaccggggttccgccatcgggcgcctcgtggtgcaagagatccgggacaacgtcaccatcgacttcgaggaattcgagatgctttacctcaccgtccgcgtgagggacctcaacactgtcatcggagatgactacgatgaggcgacgttcacgatcacaataatcgacatgaacgacaacgcgccgatcttcgcgaacggcacgctgacgcagacgatgcgcgtgcgcgagctggcggccagcggcacgctcatcggctccgtgctcgccaccgacatcgacggcccgctctacaaccaagtgcgctacactatacaacctagaaacaacactcccgagggattagtgaagattgacttcacaactggtcaaattgaggtggatgcgaacgaggcgatcgatgcagacgaaccctggcgcttctacttgtactacaccgtcatcgctagcgacgagtgctccctggaaaaccgcacggaatgtcctccagattccaactacttcgaagttccaggcgatatcgaaatagaaatcatcgacacaaacaacaaagtgcctgagccgctcactgagaagttcaacacgacggtgtacgtctgggagaatgccacgagcggcgacgaggtggtccagctgtactcccacgaccgtgacagagacgagttgtaccacacggtacgatacacgatgaactttgcggtgaacccccgactgcgggatttcttcgaggtggacctggacactggtcgccttgaggtgcattacccgggggacgaaaaattggaccgcgatggggatgagcctacacatactatctttgtaaatttcatcgataacttcttttctgatggtgacggtaggagaaaccaggacgaagttgaaatatttgtcgttctattggatgtgaacgacaacgctcctgagatgccattgcctgatgaactccggtttgatgtttccgaaggagcagttgctggtgtccgtgtactcccagaaatctacgcaccggacagggatgaaccagacacggacaactcgcgtgtcggttacggaatcctggacctcacgatcaccgaccgagacatcgaggtgccggatctcttcaccatgatctcgattgaaaacaaaactggggaacttgagaccgctatggacttgagggggtattggggcacttacgaaatattcattgaggccttcgaccacggctacccgcagcagaggtccaacgagacgtacaccctggtcatccgcccctacaacttccaccaccctgtgttcgtgttcccgcaacccgactccgtcattcggctttctagggagcgcgcaacagaaggcggcgttctggcgacggctgccaacgagttcctggagccgatctacgccaccgacgaggacggcctccacgcgggcagcgtcacgttccacgtccagggaaatgaggaggccgttcagtactttgatataactgaagtgggagcaggagaaaatagcgggcagcttatattacgccagcttttcccagagcaaatcagacaattcaggatcacgatccgggccacggacggcggcacggagcccggcccgctttggaccgacgtcacgttttcggtggtcttcgtacccacacagggcgacccagtgttcagcgaaaatgcagctactgtcgccttcttcgagggtgaagaaggcctccgtgagagttttgagctgccgcaagcagaagaccttaaaaaccacctctgcgaagatgactgccaagatatctactacaggtttattgacggcaacaacgagggtcttttcgtactggaccagtcaagcaacgtcatctcccttgcgcaggagttggaccgcgaggtggccacgtcttacacgctgcacatcgcggcgagcaactcgcccgacgccactgggatccctctgcagacttccatcctcgttgtcacggtcaatgtaagagaagcgaacccgcgcccaattttcgagcaggacctttacacagcgggcatttcgacgttggacagcattggccgggaattgcttactgtcagggcgagccacacagaagacgacaccatcacgtacaccatagaccgtgcgagcatgcagctggacagcagcctagaagccgtgcgcgactcggccttcgcgctgcatgcgaccaccggcgtgctttcgctcaatatgcagcccaccgcttccatgcacggcatgttcgagttcgacgtcatcgctacggatacagcttctgcaatcgacacagcccgtgtgaaagtctacctcatctcatcgcaaaaccgcgtgaccttcattttcgataaccaacttgagaccgttgagcagaacagaaatttcatagcggccacgttcagcaccgggttcaacatgacgtgcaacatcgaccaggtggtgccgttcagcgacagcagcggcgtggcgcaagacgacaccaccgaggtgcgcgcgcacttcatccgggacaacgtgcccgtgcaggcacaagaggtcgaggccgtccgcagcgacacggtgctgctgcgcaccatccagctgatgctgagcaccaacagcctggtgctgcaagacctggtgacgggtgacactccgacgctaggcgaggagtcaatgcagatcgccgtctacgcactagccgcgctctccgctgtgctaggcttcctctgcctcgtactgcttctcgcattgttctgtaggacaagagcactgaaccggcagctgcaagcactctccatgacgaagtacggctcggtggactccgggctgaaccgcgccgggctggcgccgggcaccaacaagcacgccgtcgagggctccaaccccatgtggaacgaggccatccgcgcgcccgacttcgacgccatcagtgacgcgagtggcgactccgacctgatcggcatcgaggacatgccgcaattccgcgacgactacttcccgcccggcgacacagactcaagcagcggcatcgtcttgcacatgggcgaagccacggacaacaagcccgtgaccacgcatggcaacaacttcgggttcaagtccaccccgtacctgccacagccgcacccaaag

SEQ ID NO: 75 - DNA, 2985 bp, Ostrinia nubilalis
atggcacgctcctgggtacttttgctggcgggggttgccctcctccagggcgtatgcaccttcaatccgttaccgcttctagaggaagaagaggcatgggaaaaattcagcagggaactgaacgatgcctctttccgactgccgacgacgacgatgccgatgcactatgaactgtccctgacaccgtactttgaagacgaagaaagaccattcactttcgatggaacagtcgcgatctacacgagcgctacggaagagaatgtctctgaaattgtgatacactgcaatgatctcactattcacagtctgactgtagagcacacagacgctgagggtgtggttcagcaaatagctgctcctcggacctacgagtgtgaagctcctcaaagcttcttgagaattgcgaccatagagccattgcaagttggacaagagtacatcatcagatcgagcttcactggcaatcttcaatccaatatgaatgggttctacaggagttggtacagagacagcaccaccacaagatggatggccaccactcagttccaacctgggtacgcgcggcaagctttcccctgctatgacgagcccggcttcaaggccacattcgacataaccatgaacagggagccagacttcagtcccaccatctctaacatgcctataaaaactactgaaaacacaactgatggccgtatatccgaaaccttctacacgactcctatcacctccacatacctgcttgccttcatcgtctcccattacgataaggtggaaactaacaacgatgaagatagaccttttgacatctatgcccgtgacaatgccaatggaaccggtgcatggtccttagaaataggaatgaagcttctagaagccatggagaattacactgattacccttactacacgatggcagaaaaaattaacatgaaacaagctgctattcctgatttcaatgcgggtgctatggaaaactggggtcttttgacttacagagaagccttaatcctatacgacccactgaactccaaccacttttacaagcagcgtgtggccaatatcgtgtcccacgagattgcccacatgtggtttgggaacctcgtcacctgcgcgtggtgggggaacctgtggctcaacgaaggcttcgcccgtttctatcaatacttcttgaccggttctgttgcaccagagctgggatatgagaggagattcatggtggagcagtacatatctgccttgtcagtggattcagttgactctgctcatgcgcttaccaacccagatgtttacaacccgacaactgtttggaaccatttctctaccatcacctacgcaagaggagcgtgcatcttgagaatgacccagtaccttcttggtcaagagacttacgttaagggacttcgcagctatctgaaggaaagggcattcgacgtagccgagcctcaccacctcttcaacgctcttgacgctgcagccagagaagacggtgctttagccgcttatggtggcatcaccatcgaccgctacttcaggacttggtctgagaaggctggacatccaatgctttctgttactattgatcaacgcactgggactatgcaagtaacccaggctcgttgggaaaggactactggttcatctgccttccctggtatttgggatattccgattacttggaccagagagggcgctgccgattttgatgatctcaaaccgtcgcagttcttgacagcccaaagcacagtaattgaaagaggcacagaaggtctcgaatgggtgattttcaacaaacaagcctctggtttctaccgagtgaactacgatgacaccaactgggctctaattgtgcaagctttaaggaacaatcccaatgtaatacacgaattcaaccgtgttcagattatcgacgatctattcaacatgggtagagccggagtcaggccttaccagcaagtgctcaaccttctgtcgttcctccaattcgatgacgagtacggaccctggatcgccgctatcgatggtttcaatttcgtgctgagaaggcttgcgcatgatgaacctaacttgcagaagctgagggatattattaacaaagaactgagtgtcgctgtaactggtcgactgggctacgtcgaggtggagaatgaaaccttcatggatggaatcttgaggatgtatctcatgaacttcctttgcgacaatggacacgaggaatgcattgcaactggcatagagaaattcgcagaatggaaggcgggaggattcattccagcaaacatgcgaccatgggtgtactgcactggactccgtttcggtgacgcggaagatttcgaattcttctggaaccgctacctgcaggaagacttagccggtgaacaaattgtcatgcttcaaaacgctggttgcaccagggacgaggccagcctacggaaattcctggatgcaatcgtatctcaacagaacattgtaagagaccaagatttcacaaccgcactcacctccgctgtatccaaaaacgaatacaacacgatgagagctttcgcatggctcaaggataatgtgaaccagactacagaagctttaggcggcattgctactccattgagctacattgtttcacggctgttgaatgaacaggacatggcagaggttcaaacttggctcaacgagaaccaagactcgattggaactgcgtacaataccggtgttaacgggatcgcctcatccagaaacaatctggcgtggtcggccagacgcatgcctgaagtctacgagtatttcgacaacggagtatatgtggaatacgaaatcgaagaccccacacaagaagaggtgaccacagaagaatctgtaacggtcactcccccagaacttgatcttgaagtaacaactgaagttgatgatgaatcagattcagctaacatcgcagcgttgagcattttcactcttattataagcgtcactattaatctaattagttaa

SEQ ID NO: 76 - DNA, 2823 bp, Ostrinia nubilalis
atgctacttctactagtagccttaatcggctcggctgtagccagcccagtatctgaagtggaatcccgcactttgaccaatgagcagctggcagcacaatacaatctacctagagaaacaatacctaccttctatgatgtcactctcttcttgaatccaagctacccagataacttcaatggcagcgtttctatcagaatcgttcctaacataacgaccaacgtcatcgtccttcacgccatggagatggaaattttaaatattgaagtcttcaacgttttaaacacgactgcagatatattccaaacacattttcttgccacggatgacactcatttcctgagaattttcacaaatgagctaatgcttcctaatcaactttatatagtcaacattgagtatagaggacaatacgcttcaaatatgtttggtatttacgtgtcgacgtacgagcaggcgggcttgggcacagtgaacttggtcacctctcagctgcaacccacattcgctcgtcgggcgttcccctgttacgatgagcctgccctcaaagctattttccgaactaccatctacgctcctcctggctacccgaccgtcaggagcaacatgcctttgagaaatgataccaataagcctgaaatcgctggatgggtaaaacatgagttccaagacactctcgacatgtcaacttatctcctggcctacctcgtctccagcttcgagtacatcagtaacgaagatgaccccatctacgaagttccctttagggtctactccaggcctggcacccaaaacaattctgaattcgctttggactttggacagaagaacatgatcgctttggagaattacattgaactgccctatgcgttccctaagctggacaaagctgcagttcctgattttgctgccggtgctatggagaactggggactggtgatttacagagaagttgccctccttgtcactgaaggtgtcacgaccacccaaacccttcaggacattggtcgcatcatctgccacgagaacatgcacatgtggttcggaaacgaggtcgggccttactcttggacctatacctggctcaacgaaggtttcgctaacttcttcgagaacttcgctactgatttggtaaaccctcaccggcgcatgatggaccagtacgtgattgccgtacaaaacgtattccagtctgatgccgtactcagtgtgaaccccatgacataccctgtcttcacgccttcccagatcatcagcactttcaatgctgtggcttaccagaaatctggttcggttattcgaatgatgcaacactatctcaccccagaaatcttcaggcaaggtctcgtgcagtacgttagcaatatgtctcgcaaagcagctcagccctccgacctcttcgctaacctccaggaagcgttagacgcctccaaccacagcattccgtggccgatagccaccatcatggaccgctggaccaaccagggaggattcccggtcctcactgtgttcaggtccgcacctactgccaactccttgaccattgctcaggaacgcttcctcaccgaccgcagtctgacctctactgaccgttggcacgtaccagtcaactgggtgctgtcaaccgaccccaacttcaacgacaccagcccacaaggatggattccaccttccttccccgccgtgtccatggacatccccggcttgaaccaagcagagtggtacatcgtgaacaaacagcagactggctactacagagtgaactacgacgtccagaactgggctgcgcttgcatccgtactgaattcaacccacgaggtcattcacgtgctcaaccgtgctcaaatcgttgatgacgctttcaacttggctagaaacggccgcgtgaactacaactatgccctcgagatctcccgctatctggtgagggaagaggattacatcccctgggctgccgccaatgctgcattcgcctaccttgacgtcgtactgactgggtcggaggtctaccatttattccagcgctacgtcttagagcttacagctcctttgtactctagcttgggctccaacaacaccgcgaacgatgagtttgtgacggcctaccacagaactatcgtgctgaacttcaactgccgctttggcaacgaacactgcgtggaggctgcgcaagagatgctggaatcattcaggactactcaggtgcgtcttgccgccgacatccagaccacggtctactgctccggtcttcgcggtggtgacgccgacaacttcgacttcttgtgggacgagtaccttaaatccaccgactctagtgagcagtccattctgctgaacgccctcggatgcacttccaacgctgatcgccggcagttctacatgaaccaagtgatcagcgagacgtcccaagtgagagagcaggacagacacactattctcgtgtccaccatcaacgctagtcctgagaacatggaggaagctcttgacttcgttgtcgagaacttccacctcatccagccaagagtacaaggtcttagtggaactacaaatattctgaatgctctctccagaaggctcacaacgcaagctcattctgacaaggttgaccagctgttcaaccgacaccagttcatcttcaccgccggagaactggcctccattggagccatcagggaaaacatcgcagcctctcccacgtggagtgcagaatacttggacactgtagaatcctggcttattgagaactatactgacagtgccagtatcattaccagcagcttcgttattttcatctctatttttatttctattttcaaccactaa

SEQ ID NO: 77 - DNA, 3045 bp, Ostrinia nubilalis
atggcgactctcaagttgctaattctggctgcagcatgccttgcggcgcaagcatttcctcaagatcctcgcccatacagaaacacaatcttcgctgacgagaaactagaaggggaagccttcgaaaacatagatgacttcgatggcaacacacaactctctagatccgatgataacccgtaccgactaccgaccacgacaaggccagaacactacaacatactgtggatggttgagatacccgctaatatcttctcgggtgaggtggaaatccagctgtacgcgactcaagaaaacgtcaacgaaatcgtcatccaagctaacggattaaatatcacttcggtggtcttgaaattgggagatactgaaataccacatacggttaccctgcagccagagtatcatttcttaagagtggccctcagtaacggcgtccttcaatacagcgcgaccaatagagttctatattcactgaatatcgaattcattgctccgttgaggactgacatgtacggaatttacgaaaactggtacaggaataatgctagtgacgaaaacgtgagttggatggcctcaacccagttccaggcgacgtctgcccgctatgcgttcccttgttacgatgagccaagtttcaaagctaccttcaacattacgctcagaaggcccgttggattcaaaagttggactggcatgagactgcagaacaacataaccagccccattgaaggcttcgtggacgatgttttctttataaccccgatacagtctacgtatcttttagctataatagtagcagaatacgaaactcttgaaaaattaaacgagattacaggggatcttgagtacgaagttatcgctagacctggtgccattcaatctggtcaagcacagtatgcttttgaagtaggacaagaactactagccgaaatgagcaatcataccgccatggacttctttagtgtccaccctcatgtcaagatgacacaggcggctattccagacttctctgccggagctatggaaaactggggactgttaacttatagggaagcttatttaatgtacgacgagaaccacacaaacagctacttcaagcagctgattgcttacatcttgtcacatgaaatcgcccacatgtggtttgggaatctcgtcacttgcgattggtgggacgtgttgtggctcaacgaaggattcgccagatattatcagtactttttaactgattgggttgaaacatacatgggactgagtacccgttttatcaacgaacaagtccatacttcgttgctgagtgactcatctaacaaccctcaaccattgaccaaccctggcataggcagtccatcttcagtcagttcgatgttttcaacaatcagttacaacaaaggtgctgctatcattagacaaactgagcatcttatgggattcgatgtccacagagaaggtttgaggagatttttggttgaaaggtcattcgagacagcactacccattcatcttttccaagctcttcaagacgctgctgtggaggcaggagctatcgcagaatacggagaggaatttaacatcatcgactattataagacttggactgaacagggtgggcatccagtgcttaatgtcgaaatcgaccaccagactggactgatgactatctatcagcgccgtttcaacatcaacagtggttactctacgcctaccactaactggattgttcctatcaccttcgctacggctagtgacccggactttaataatactaagccatcccatatcattagagatggtatcaccgtcattaaccggaacagtatcggtgatgagtgggtcattttcaacaaacaacaaactggttactaccgagttaattacgatgactactcatggaatctaattatcaacgcattaagaggacctgacaggactcaaatccatgaattcaacagagctcagatcgtcaacgatgtgttccaattcgcccgctctggaatcatgacgtacaccggggctttcaatatcctctctttcctcgagaacgagacggaatatactccatgggtcgccgccattaccggcttcaactggatcaggaacaggctcattggcagctcctatctcgctgaacttgaagcgatgatcgcaaattgggccacgacagtgatgaaccagctcacttactacccgcgccccgacgagtcgttcatggattcgtacttgcggtaccaactggctcctttcatgtgcaacttaaaccaaacagcttgccgcgaagccgccgttagccagtttgaagctttgcgctataatgacactgaggtgccagtggacagccgtaactgggtgtactgtaacgccctccgccaaggttccgaggaagacttcgatttcctctgggaacgcttccaaaaccacaacgtgtacacggaaaagatcgttctacttcaagtgttgggttgcactcctcacgaggcttctcttaaaacacttctagacgcaatagtgacgcccaactttgtcatccggcgccaggactatacgactgcgttcagtaccgcggtcaatggcaacgaaggcaacacgcagatcgtattcaactacatccagaccaacctcactcaagtagcagctgcatttggtacgattctaaatcctataaattacgcaacacccttatcttacatctcagcaagactaaggtctactgaagaaattgataatttccaagcatgggccaatgcgacgcaagacatattaggtaacagctacaattccatctacaacagcgccgagtccagtcgcgactctctccagtgggctgttgaagtccaaagtgacatagaaaattacttgaccgagggtgacgagacttacgaggcttctagtgaaacgccagtcgtcactgatgccccggttacagagacacagccgccattggaagaaccaactactcctgagctctcagagtctgactcagccaacactgccttcttgtcagtgcttgtcatcgctgtcgctgccgctgcaaactttgcgctataa

SEQ ID NO: 78 - DNA, 2844 bp, Ostrinia nubilalis
atggggtcaatcatgttactcccaatcctgttcttcctcgcgggggtagctgcttaccccaatgaggacatgagatctgacttggagttcttcgggtactccacaaacttggacgatcctaaataccgtctcacagactctgtgcagcccagagacgtgtatgtgcatttggatgtgcatgtcgtggaggctagattcgacggttttattcagctcgacgttgaaatcgaagaatcgggcatgactcagatcgtgctgcatcaaaaagtggtgtcgatccagactgtcaatgtccttgattccgctggcagacccgtgaaccttcagttccctaacccattctctactgatgatcacttcgagatcctcctcatcaacttggctgaccccatatcagctggtaactacaccatcaccatctcatacttgggcaagatccacgagaaccagtatgacagaggtttttaccaaggctactatttctacaacggagagaagaggtactacgccacgactcagttccagcccttctacgccagaacaaccttcccttgcttcgatgagccgcagtttaagtcgcgattcgtcatctctttcactcgtgacagctctttgcagccctcctactctgacatgcccattggtgaaactgttgagacttctcccggccgtattcgtgagaccttcctccccactcccattgtttctgcatatctcgtcgccttcacagtcagtgacttcgttgccaccaacttaaccaccacgtccaccagacccttccaaatcgtctctcgcccaggagttacctcacggcatgtgtacgccgctggtatcggtttggacatcaccaacgaactggatgattacttgggaattgagtattatgaaatgggtcaaggagtgccaatgaagaacgatcaccttgctattcctgattttccttctggtgctatggagaactgggggatggtaactacagcgtacttgttgtacgatgaggagaacacaaatgtgatcaacaagattttcatcgctaccatcatggctcacgagctcgctcacaaatggttcggtaacctggtcacctgtttctggtggagcaatctttggctgaacgagtccttcgctagctttttcgaatacttcgcagctcattacgctgacccatcattggagttggatgaccaattcattgtggactacgtacatagtgccctcagctgggactccggttcaggcgctacacctatgaactggaccggagtggttaacaacccctccatctggtcccacttcagtaccaccagctacgccaagggagcttcagtattgcgtatgatggaacacttcatgggcgctcgtccattcagacaaggactgagatactacttgagagaaaatgcctacggtcttggaaccccagaagatctgtaccgagcgttgagacgtgcggcttatgaagacatggcgttcagacgggacttccccgatgctgacgttggacagatcttagacaactgggtgcagaaccctggttccccagttgtgaacgttgatgtcaacatggacactggattgatcaccctcacccaggaacgtttccttctgagtggtaccccagtagcccagctctgggatattcccatcacttggacccaccgaggagaactcaacttcgagagcacaaggcccagttttatcctctctactgcgagtactactatccagaacactcccggtcatttctgggtgatcctcaatattgctcagtcaggcttgtaccgtgttaactatgacgaccataactgggaaatgcttgcttcttacctccgcaatgcaaacactctcacaaatgtccacaaactcaacagggctcagatcgtgaacgacgtgttgttctttatcagagccggcaagatcagcctcgaaagagcttttgacgttctatccttccttaagattgagaccgactactatgtctggaacggcgccattactcagctggaatggattaggaagagaatggaacatattcctctagctcaccagaaattcaccgaatacatgctagatatcctggatgcggcaattcagcacttgggatatgaggagctcgctaccgattccacgtctaccatcctcaaccgcgtgcaactcatgagcttggcttgcaaccttggccattctggatgtatcgccgacagtcttaacaagtggcgtgcgtttgtggccgacccaaccaccttagtgccagtaaacgctcgtcgttacgtatactgtaccggccttcgagagggcgatgcttcagactacgagttcctactcaatctctatgagacttcggaaaacactgccgacatggtcgtcatgctccgtgcccttgcctgcacgaaggacaccgcctcactgaaccaatacctgaaccagtcgctgaccaacgacaagagtcgcttccacgaccgcaccaacgcgtttgcttacgcgctccaaggcaacgttgagaacctgccgactgtcctgggcttcttgtataacaactttgctgccatcagagaagcgcacggaaaccaggaccgactcatcgtcaacatcaacaacgtagctggattcttgaccaactacgagcatattgttgaattccaaacctgggcgtacgctaaccagttggcgctcggcagcgctttccagaacgctgtcaacgtcgtcaacagtgccatgaacaacctcaactggggaaacagcgttgctgctgaggtctacgacatactcctggcgaggaactccgctgctgccattgtttctcccatcgctctcatcctggctgcgatggccactgtcctttaa

SEQ ID NO: 79 - DNA, 1614 bp, Ostrinia nubilalis
atgcgcggtgctgtgttggtgacgacgctggtgctggtggtgcaggcgcgcggcgcggtgcgcgaccgctaccacccgaacgcgcgcgcggccgggcgctcctccgccgccgagcgcgacccggcgcactgggccgccgaggccgccgccgccatcgacgagcgcgtgcggcgccgcaacaaccgcaacgcggcgcgcaacgtcgtcatgttcctgggcgacggcatgtccgtgcccacgctcgcggccgcgcgcaccctcctcggccagcgcaacggccagaccggtgaggaggcccagctttctttcgaggccttccccacttcaggtttttctaagacttattgcctggacgctcaaatcgcagattcagcacgcacagcaaccgcatacctttgcggcgtaaaggctaatataggcacaatcggtttgaatggtaacgtagtgcgaagggattgcgacgcctccttcaacaccgacaaccacgtcgagtcgatcgcggcgcgggcgctagaggacggacgagatgcaggtatagtgaccacgacccgtgtcacgcacgcgtcgcccgcgggtgcattcgcaaacatagccaacagggactgggagaacgacgagagcgtgcgcgaggacggcgccgaccccgcgcgctgccccgacatcgcgcaccagctcgtccacacgagcccagggaatcagttcaaggttatattgggtggcggaagaagagaattcttgcctttcaacttcaccgatgaggaaggttcgcccggtgttcgccacgacaatcgtaacttaatcgaagagtggcaagaaaacaaagcagcacaaggtgcgagctatgcccacgtttcgaatagggaccagttgatgaacgtgtcatcgtcgttaccggactatctgctgggtctatttgagaacagccacatgcagtaccacttggaagccaacaacgttaccgagcccacactcgcggagttaacagaaatagcgattaagtccttgagccgcaacgagaaaggtttcttcctgttcgtggagagcgggcgcatcgaccacggccaccacgacaactacgtggagctcgcgctggacgagaccatccagatgagcgaggcggtgcgggtcgccaccgagctgctgtccgaggaggactcgctcatcgtggtcacggccgaccacgcgcacgtgatggccttcaacggctacacgcagcgcggcggggacatcctcggcgtctccgacgaccgggacgaggacggcgtgccctacatgacgctgtcgtacacgaacgggccgggcgcgcggcagcaggtgaacggcacccgccccgacgtgacgacggaggacgacttcggcggcaggcgctggcgggcccacgtcgagatcccgctggactcggagacgcacggcggcgacgacgtgggcgtgttcgcgcgcgggccgcaccacgacttgttcacgggcgtgtacgagcagagccagctgccgcacctcatggcctacgccggctgcttcgggccgggcccgcacgcctgcaacgcgggccccgccactcacattccgtactttttgctggctttaataactctatgccaaatcttacgactgtag

SEQ ID NO: 80 - DNA, 1635 bp, Ostrinia nubilalis
atgcgcggtgctgtgttgctgtcaacgttggtgctggcggcgctggcacgcggtgcggtgcgcgaccgctaccaccccgacgcgcgcgcggcgcccgagcccggccgcgcggccgcgcgctcctccgccgccgagcgcgacctggcgcactgggccgccgaggccgccgccgccatcgacgagcgcgcgcggcgccgcaacaaccgcaacgcggcgcgcaacgtcgtcatgttcctgggcgacggcatgtccgtgcccacgctcgcggccgcgcgcaccctcctcggccagcgcaacgaccagaccggcgaggaggcgcagctttctttcgaggccttccccacttcaggtttttctaagacgtactgcctggacgcccagattgcagattcagcttgcacggcaaccgcgtacctttgcggcgtgaaggccaaccgaggcactatcggcgtcaacggtgacgtaccgcgatgggactgcaacgcctccactgaccccgatacccatgtcgaatctatcgcagcgtgggcgctgaaggacggacgagatgcaggcgtggtgaccacgacgcgcgtcacgcacgcctcgccggcgggcgcgtacgccagcgtggccaaccgccactgggagaacgacgacgcccgtgcgcgaggacggcgccgaccccgcgcgctgccccgacatcgcgcaccagctcgtccacacgagcccagggaatcagttcaaggttatattgggtgcggaagaagagaattcttgcctttcaacttcaccgatgaggaaggttcgcccggtgttcgctacgacaatcgtaacttaatcaaagagtggcaagaaaacaaagcagcacaaggtgcgagctatgcttacgtttcgaatagggaccagttgatgagcgtgtcatcgtcgttaccggactatctgctgggtctatttgagaacagccacatgcagtaccacttggaagccaacaacgttaccgagcccacactcgcggagttaacagaaatagcgattaagtccttgagccgcaacgagaaaggtttcttcctgttcgtggagagcgggcgcatcgaccacggccaccacgacaactacgtggagctcgcgctggacgagaccatccagatgagcgaggcggtgcgggtcgccaccgagctgctgtccgaggaggactcgctcatcgtggtcacggccgaccacgcgcacgtgatggccttcaacggctacacgcagcgcggcggggacatcctcggcgtctccgacgaccgggacgaggacggcgtgccctacatgacgctgtcgtacacgaacgggccgggcgcgcggcagcaggtgaacggcacccgccccgacgtgacgacggaggacgacttcggcggcaggcgctggcgggcccacgtcgagatcccgctagactcggagacgcacggcggcgacgacgtgggcgtgttcgcgcgcgggccgcaccacgacctgttcacgggcgtgtacgagcagagccagctgccgcacctcatggcctacgccggctgcttcgggccgggcccgcacgcctgcaacgcgggccccgccactcacattccgttctttttgctggcattgattactctatgccaaatcttacgactgtag

SEQ ID NO: 81 - DNA, 5190 bp, Helicoverpa zea
atggcagtcgacgtgagaatattgacggcagcggttttcattatcgctgctcacttgactttcgcgcaagattgtagctacatggtagcaatacccagaccagagcgaccagattttccaagtctaaatttcgatggaataccatggagtcggtatcccctgataccagtggagggtagagaagatgtgtgcatgaacgaattccagccagatgccttgaacccagttaccgtcatcttcatggaggaggagatagaaggggatgtggctatcgcgaggcttaactaccgaggtaccaatactccgaccattgtatctccatttagctttggtacttttaacatgttggggccggtcatacgtagaatacctgagaatggtggcgactggcatctcgtcattacacagagacaggactacgagacgccaggtatgcagcagtacatcttcgacgtgagggtagacgatgaaccgctagtggccacggtgatgctgctcattgtcaacatcgatgacaacgatcctatcatacagatgtttgagccttgtgatattcctgaacgcggtgaaacaggcatcacatcatgcaagtacaccgtgagcgatgctgacggcgagatcagtacacgtttcatgaggttcgaaatcagcagcgatcgagacgatgacgaatatttcgaactcgtcagagaaaatatacaaggacaatggatgtatgttcatatgagagttcacgtcaaaaaacctcttgattatgaggaaaacccgctacatttgtttagagttacagcttatgattccctaccaaacacacatacagtgacgatgatggtgcaagtagagaacgttgagaacagaccgccgcgatggatggagatatttgctgtccagcagttcgatgagaagacggaacaatcctttagggttcgagccatcgatggagatacgggaatcgataaacctattttctataggatcgaaactgaaaaaggagaggaagacttgttcagcattcaaacgatagaaggtggtcgagaaggcgcttggtttaacgtcgctccaatagacagggacactctagagaaggaagttttccacgtgtccataatagcgtacaaatatggcgataatgacgtggaaggcagttcgtcattccagtcgaaaaccgatgtggtcatcatcgtgaacgatgtcaatgatcaggcgccgcttcctttccgggaagagtactccattgaaattatggaggaaactgcgatgaccctgaatttagaagactttgggttccatgatagagatctcggtcctcacgcacaatacacagtacacttagagagcatccatcctccccgagctcacgaggcgttctacatagcaccggaggttggctaccagcgccagtccttcattatgggcacgcagaaccatcacatgctggacttcgaagtgccagagttccagaatatacaactgagggccgtagcgatagacatggacgatcccaaatgggtgggtatcgcgataatcaacattaaactgatcaactggaacgatgagctgccgatgttcgagagtgacgtgcaaactgtcagcttcgatgagacagagggcgcaggcttctatgtggccactgttgtggcgaaggaccgggatgttggtgataaagtcgaacactctctaatgggtaacgcagtaagctacctgaggatcgacaaggaaaccggcgagatattcgtcacagaaaacgaagcattcaactatcacaggcagaacgaactctttgtgcagataccagctgacgacacgctgggcgagccttacaacaccaacactactcagttggtgatcaagctgcgggacattaacaacacccctcctacgctcaggctgcctcgcgccactccatcagtggaagagaacgtgcccgacgggtttgtgatccccacgcagctgcacgccacggaccccgacactacagctgagctgcgcttcgagatcgactggcagaactcgtatgctaccaagcagggacggaatactgactctaaggagtatatcggttgtatagaaatcgagacgatatacccgaatataaaccagcgaggcaacgccatcggccgcgtggtagtgcgagagatccgggacggcgtcaccatagactatgagatgtttgaagttctatacctcaccgtcattgtgagggatctcaacaccgttattggagaagaccatgatatatccacattcacgatcacgataatagacatgaacgacaaccctcccctgtgggtggaaggcaccctgacgcaagagttccgtgtgcgagaggtggcagcctcaggagttgttataggatccgtactggccactgatatcgacggaccgctgtataatcaagtgcggtatactattactcccagactagacactccagaagacctagtggacatagacttcaacacgggtcagatctccgtaaagttacaccaggctatagacgcggacgagccgccgcgtcagaacctctactacaccgtcatagctagtgacaagtgtgacctccttactgtcactgagtgtccgcctgaccctacttactttgagacaccgggagagattaccatccacataacggacacgaacaacaaggtgcctcaagtggaagacgacaagttcgaggcgacggtgtacatctacgagggcgcggacgatggacaacatgtcgtgcagatctacgccagcgatctggatagagatgaaatctaccacaaagtgagctaccagatcaactacgcgatcaactctcgtctccgcgacttcttcgagatggacctggagtccggcctcgtgtacgtcaacaacaccgccggcgagctgctggacagggacggcgacgagcccacacatcgcatcttcttcaatgtcatcgataacttctatggagaaggagatggcaaccgcaatcagaacgagacacaagtgttagtagtattgctggacatcaatgacaactatccggaactgcctgaaactatcccatgggctatctctgagagcttagagctgggtgagcgtgtacagccagaaatctttgcccgggaccgcgacgaacccggaacagacaactcccgcgtcgcctatgccatcacaggcctcgccagcactgaccgggacatacaagtgcctaatctcttcaacatgatcactatagagagggacaggggaattgatcagacaggaatacttgaggcagctatggatttgagaggctattggggcacctatcaaatagatattcaggcgtatgaccatggaatacctcaaaggatttcaaatcagaagtacccgctggtgattagaccttacaacttccacgacccagtgttcgtgttccctcaacctggatccactatcagactggcaaaggagcgagcagtagtcaacggtatactggctacagtagacggcgaatttctggacagaatcgttgccaccgacgaggatggtttagaagctggacttgtcacattctctatcgccggagatgatgaagatgctcagttcttcgacgtgttgaacgacggagtgaactcgggtgctctcaccctcacgcggctcttccctgaagagttccgagagttccaggtgacgattcgtgctacggacggtggaactgagcctggtccaaggagtacggactgcttggtgaccgtagtgtttgtacccacgcagggagagcccgtgttcgaggataggacttacacggttgcttttgttgaaaaagatgagggtatgttagaggaggcggaactacctcgcgcctcagacccaaggaacatcatgtgtgaagatgattgtcacgacacctattacagcattgttggaggcaattcgggtgaacacttcacagtagaccctcgtaccaacgtgctatccctggtgaagccgctggaccgctccgaacaggagacacacaccctcatcattggagccagcgacactcccaacccggccgccgtcctgcaggcttctacactcactgtcactgttaatgttcgagaagcgaacccgcgaccagtgttccaaagagcactctacacagctggcatctctgctggcgatttcatcgaaagaaatctgctgactttagtagcgacacattcagaagatctgcccatcacttacactctgatacaagagtccatggaagcagaccccacactcgaagctgttcaggagtcagccttcatcctcaaccctgagactggagtcctgtccctcaacttccagccaaccgcctccatgcacggcatgttcgagttcgaagtcaaagccactgattcaaggacagaaactgcccgcacggaagtgaaggtgtacctgatatcagaccgcaaccgagtgttcttcacgttcaataacccactgcctgaagtcacaccccaggaagatttcatagcggagacgttcacggcattcttcggcatgacgtgcaacatcgaccagtcgtggtgggccagcgatcccgtcaccggcgccaccaaggacgaccagactgaagtcagggctcatttcatcagggacgaccttcccgtgcctgctgaggagattgaacagttacgcggtaacccaactctagtaaatagcatccaacgagccctggaggaacagaacctgcagctagccgacctgttcacgggcgagacgcccatcctcggcggcgacgcgcaggctcgagccctgtacgcgctggcggcggtggcggcggcactcgcgctgattgttgttgtgctgctgattgtgttctttgttaggactaggactctgaaccggcgcttgcaagctctgtccatgaccaagtacagttcgcaagactctgggttgaaccgcgtgggtttggcggcgccgggcaccaataagcacgctgtcgagggctccaaccccatctggaatgaaacgttgaaggctccggactttgacgctcttagcgagcagtcgtacgactcagacctaatcggcatcgaagacttgccgcagttcaggaacgactacttcccacctgaggagggcagctccatgcgaggagtcgtcaatgaacacgtgcctgaatcaatagcaaaccataacaacaacttcgggtttaactctactcccttcagcccagagttcgcgaacacgcagttcagaaga

SEQ ID NO: 82 - DNA, 3045 bp, Helicoverpa zea
atggcgaaccgctggtacaccctccttttgggggccgctcttctgcagagcgtcctctccttcggtcctattgaagtgacagacgacgaatgggctgaatacagaaacctgatgcgggaccctgcttaccgcctgcccacgactacgaagcctagcaactacgccgtcaaccttacaccacatttcactggcaccaccttagctttcacctttgagggctcagtacgcatcaccattacggccacgcaggctaatgtcaacgaaattgtgctccattgcaatgacttgaccatcgaatcggtcatggtggctaccgaagctagcccgaatgttaatcttattgcaagcggacagacttttgtctgcgatcctgtatacagtttcctaagaataaggaccgcatcagccttgaatattgacacgaattatataatcacgagtaacttcagaggcaaccttcaaacgaacatgagaggtttttacaggagttggtatgtcgactctagtggtaccaagagatggatggcaacgacccaattccagcctggccatgctcgccaagccttcccctgctacgacgaaccaggattcaaagccactttcgatattaccatcaacagggaagccgacttcagcccaaccctttccaacatgcccattataactacaactcccctcgcaaccggcagagttgctgagacgttccacaccactcccgaaacatctacgtacttgattgcttttatagtatcgcactatagtcaagtagcttcaaacaacaacctgcagaggcctttccatatctatgctagagacaatgttggagtccatggaaacttcgccttggaaattggagtgcctctcttggaagtcatggagcgctatacagaaattccttactatggcatggctcaaaacatgaacatgaagcaagctgctatccctgacttctcagctggtgccatggagaactggggacttttgacttacagggaggctttgattctgttcgatcccgtgaataccaacaacttctacagacagcgtatcgccaacatcatttctcacgaaatcgctcacatgtggtttggaaacctcgtcacatgcgcttggtgggacaacctttggctgaacgaaggttttgcacgattctaccagtactacttgactggcgtggtcgctcctgaaatgggcttcgaaactcgtttcatagtggaacagctgcacgtgtcgatgttgtctgactcccttgactctgctcacgccctcaccaaccccaatgtgaacgaccctactactgtcagcgcacacttctccaccatcacttatgccaaaggcgccagcatcatcagaatgacacaacacttactgggcaacaacacttttgtgaaaggccttaggacttacttgaaagacaatgcctacggtgtcgctgagccccgtcacttgttcactgtcttagacgctgctgcaaccgcagacaatgctctcgccaactatggtggtatgaccatcgatcgttacttcagaagctggtcagagaaagctggtcatccattgttgactgtgtccattgaccactcctctggacgtatgaccattattcaaacccgatttgagcgcaatactggtgtatcaacagcgaccgacagtctttgggacatccccattacttggactagggcaggatctattgactttgacaacctgaaacctacgcaattcatcagtggtgttttgactatcatcgacagaggaaccactggcagggaatgggttattttcaataagcagcaaactggtttctatagagttaactacgatcaaatcacttggggtctcatcactcaagctcttaggagtaacgtgaggctatcaatccacgaatataaccgtgctcagatcgtcgatgacgttatgttgttagctcgagctggcattatgacctacagcagagccttgaacattctctccttccttaaatttgaagatcaatatgctccttggggcgcagctattactggattcaacttcgccctccgaagattagctcatgatgttacagctcaccagaaactgaggaatgaaatcttggatttgagcacggccatcgttaatcgtttgggcttcagcgagccagctgttagcaatttcatggacgaccttctccgcatgaacgtcatgactttcctttgtgacatcggccaccaggggtgcatcactgttgctagaactagctttgctacctggaagaacggtggagttgtcccacccaacatgcgtccatgggtgtattgcaatggagtgcgctacggagatcaatctgacttcactcacttgtggaatcgttacacagcatctgacgttgctaacgacaagctggtaatgttgtcggccgctggttgcacacttaaccaggccagcttgaacatattcctcaatgccatcgtgtctggaagcgatgacatcaggcctcaagaccacagcgcagctatcgcagcggctgtccgcagtaatgaagtgaacactatgagagtattcacatggctgcaagctaatgtgcaacagactataaacactctgggaagcgtcagtcctattttgaacgaaatcacagctcgcctattgaatgaagcccaaatcactcaggttcaaacttggttgaatgcaaaccagaacttaattggtactgcagctcacactagcgccacaaatggcatcgccacgtctaggtccaacattcagtggtacacacagagggttcccgaattcaacgtatactttgaaactggatatgttgaagagaacttcgctgacactacaactaccagtacgactacgactacgacaactactacgaccactacagcagctcctacgactacgacaactacagaggcgcctgcgacaacaactacgaccactacgggagcgcctacgaccacaactacagaagctacaacaacacctgtacctggctcagcaaacatcgccactcttagcatcgtcacaatgatcgtgactctcgttgttaatatggcttaa

SEQ ID NO: 83 - DNA, 3123 bp, Helicoverpa zea
atgcaattcatcaccatcatactcctggcgtcggccgccatcatctcggccgacttccctcttccaccggaatttgatgaaccggagttcttcagtagttctgacccagattcctaccggctccccgaagatctggaccccataaattatgttgtggaagttaccccttacttcactgctacagataccaaggaggcgttcacttttgatggtattgttaccatcacgcttaggacactcaaagctgacctgaacgcgctcatcattcaagagaacgtacgcacaataaattccgtagctctaaccaccgaagccggtaccactgttcctcttcatgccactaatccattcgaacgcataagtgcctaccatttcttgaaagtcaacctacctgctggggctactttagaaaatggagcagtttacaagctgactgtcgattatgtcggtaacattaatgagacaccattatcccgaggtgtatttagaggaagccataaggacgcaaatggtaatatacgctggtacgcagctactcatttgcaaccaacaaattcaagacaagcatttcccagcttcgatgagcctggtttcaagtctaccttcgacatcatcatcaacagaccagtaacctttgctccgtccttctccaatatgggaatcagatcaagcgatttggtcaataaccgcattagggaggtgttctatactaccccgcggatgtcagcctacttggtaaccttccacatcagtgaagacttcactgtcatcgccgacaacaataacgaagcgagatcttacagaatcttagcccgacccaccgctgccggccaaggacaatacgctctagaagtcggacctccagtgactaattggctcggcgaatatttaggtattgactactacagcatggacgagaacactaatatgaagaacgatcaaatagcttctccttattgggcttcaggagccactgaaaactggggattggtaacatacagggaactgcgtctgttataccaagaaggtgagaccaatgctttggacaagatgtacatcggtactattactgctcatgagctcgctcacaagtggttcggaaacctcatcacctgcagatggtgggataacgtctggatcaatgaaggcttcgctagctacttcgaatatttcgccatggatggagtagacaaatctatggaattagaagatcagttcaacattatgtacgttcaaagcgcactctctgctgatgccacgctttcgacaagggcccttcaacacacagtgaacagcccaaccgaagtcacaggacacttcagtggtatcagctactctaagggagcttctttgctcctcatgttgaagcatttccttacggaaaatactttcaaaaaggctttgaacatattcttggaagccaggaaattcgaacacgctttcccagcagacctctacagtgcttttgctacagcagttcagcaagatggtgtaccatcaaacaccttcgatattgcatcattcatgaaatactgggtagaggaaccaggatatccagtccttgaagtttctgtcaattcagcagctggtcgcattgagctatctcagaaacgtttcttagtcagcgccactgccacgcctaccgaccaagtttggccgctgccccttacttacacaactgagagcaaccctgactggcagaatttgttacctagtaaagtgatgactgcaaagactgacttcattgaaaggactgtaggtgcaaatgaatgggtcatcttcaacgttcaacagaaaggtatctaccgtgtgaactatgacactcgcaactgggagttgcttgcagccgccctgagcagagaccacacggctatccatcatttgaacagagctcagatcgttgacgacgttttcgctctgatgagatctggacaaataacgtatcgtctcggattcaaagttctggacttcttgaagaaggacaccagctactactcgtggtatccggctattactggttttaactggctgaggaaccgtttcctccatctccctacgactttggctgcttttgacgaaattctctacggcttcttagatgctgtgataacggatcttggatatgatgtagttgcaaatgaacctctaacgagaacactcaatagattcttcacactgtcattcgcttgcaacattggacacaaaggttgtgtcgataatgctgtacaaaagttcgtggctttgaaggataacagtgtcgctgtcaaccctaacctgaggcgccacgtgttctgcgaaggtctccgtgccggcggtctcgacgagtggcagttcctatacaatcgtcgtcaagcctccaacaaccagggagatgaagttgctatgctcagatccttagggtgcaccagcaacactgccgctggacaggcgtacttgaaaatgattttggaagacgatgacgtgaaagcccaggaccgagtgaatgcattctcgttcttctacatgggacatcgtgacaacgccaaggctggtctgcaattccttaaagacaacgttgatgctatcagaaaagctgtcgtccttccagcgtggtttaacaacgttctcacaaccaccgccagctatttagacgaagctggtctgaaggatatggaagaatggctgttagctaaccaaaacgctgtccctgaattcgctgtgggcatcaacgccataacctcagctagaaataacatgcagtggggttcagacaatgcagctaccattatagctgcagccaatgatgaagatcccccagaagatggtggttcaggagaagaagtagacccaacacctgcgccgactacaactacaacagaagcgccaactacaactacaacagaagcgccaactacaactacaacagaagcgccaactacaactacaacagaagcaccaactacgactacaacagctgaaccaacaacagaagggtctggcgaagaatcaacaacacctgatggatcatcaactacagcagcgccggagtcaggtgaaagtgaagaagatgaatcaagttcagcagcaatcttcctgccaaccaccgtgctgctgtcgtggacagtactcgcaatgttgttataa

SEQ ID NO: 84 - DNA, 3042 bp, Helicoverpa zea
atggcggcgataaaactcttagttttatccttggcttgcgcatgtgtgattgcgcactcgcccatccctccagtcagcaggaccatcttcttagacgagcgtcttgaaggaggtgccttcgagaatatcgacgccttcaagaacatcgaactgagcaacgccgccgcttctccctaccgtctgcccaacactaccttccctacccactacaaagtattatgggttatcaaccttagtgataacgaacaaacctacagcggtaccgtcgatattactcttcaagctacacagccaaatgtcaatgaaattgtcatccactgcgaccacttgacggtcacctctgtggtcttgaggcaaggaacggcaacggaaggaacattgatccccaccacccctacacctcaatctcaataccacttcttgagggtcgcacttaatgatggcgttctcttgtataatgaaaatgtccccgtgcaatataccctttccattgcattcaatgccgaaatgcgtgatgacatgtacggtatctacagaagttggtacaggaacttgcccacagataacaatatcaggtggatggcaacgactcagttccaagccacagctgctcgctacgctctcccttgctacgacgagccagggtacaaggccaagtttgacgttacgatcagacgtcccttaggctacaaaagttggttctgtaccaggcagcggatcaccagaccatcaaccactggttacgcagagggtgagtatcacactaccccggaaatgtctacctaccttctagctttaattgttgctgactacgactctcttgcaactctcgatgctaacgatagagttttgcatgaagttattgcaaggcccggagcaattatcaatggacaagcagcctatgctcaaagagctggccaagatcttctaggaaatatgagcgaccacacgggctttgacttttacaaacaggacgaaaaccttaaaatgactcaagctgctattcccgacttcggtgcaggcgctatggaaaactggggcttgctgacttatagggaagcttacattctgtatgacgaacaacacacgagcagcaacttcaagcaaatcatcgcttatattctctcccatgagatcgcgcacatgtggttcggtaacctagtcaccaacgcctggtgggatgtgttgtggctgaacgaaggttttgccagatattaccagtatttcctcactgcatgggttgaagacatgggtctcgccactcgtttcataaacgagcaggtgcacgcatctttgctcagtgactcgtcaatttacgcccatcctctcaccaaccccggtgttggtagcccagccgccgtcagcgctatgttctccactatcacctacaacaagggtgcttctgtcatcagaatgactgagcatcttctcggctttgaggttcatagggcaggtcttaggaaatacttggaggatatgaaattcaaaacagttcagcctattgatttgttcactgctctggagactgccggtaacgatgcaggtgccctcgacgcttatggagatcacttcgacttcgtaaagtattacgaaagctggacggaacagccaggacaccccgtgcttaatgtgcacatcaatcaccagaccggacacatgaccatttaccagcgtcgtttcgacatcgacactggctactcggtccaaaacaggaactacattgttcccatcactttcacgaccggagccgatcccgacttcagcaacacgaagccctctcatgttatctccaaggctgttaccgtcatcgaccgtggagtggtcggtgatgtctggaccattttcaacattcaacagactggtttctacagagtcaattatgatgattacacctgggacttgatcatacttgccttgagaggcgctgacagggaaaagattcatgaatacaaccgtgctcagatcgtcaacgatgtattccaattcgcccgttccggcctcatgacgtacgaacgtgcattgaacattctcccctacttggaaaatgagactgattacgccccatgggttgctgccattactggcttcaactggcttagaaacagattggttggcaaacctcagcttgcagaacttaatgcaaagatcgtccaatggtcatcgaaggtaatgtccgagctgacatacatgcctattgaaggagagcccttcatgcggtcatacttgcgctggcagctagctccagttatgtgcaacttgaacgtacccgcttgccgcgctggtgccagagtcatcttcgataatcttcgtcttcatcaacacgaagtaccagtggacagccgtagctgggtatactgcaacgccctccgtgatggtggagccgtggaattcgaccacttgtataataggttcaaggcacacaatgactacactgagaagatcctcatccttcaaacccttggctgcacaagtcaccctgcctctttgaccacattgctgaacgatattgccacgcccaacaatatcattcgtccgcaagactacaccacagctttcagcactgctgtttcaggcaatgaagaaaacacactctttgttctcaattacatccagaataacctggagactgttttgaaagcctttacgtctccaagaacacctctatcctacatcgcggctaggctgaggacagttgaagacgttaccgcgtaccaaacttggctgaaccttaccaccactcgcgaggtccttggtaccagttacaataacatctacggagactctgttgccgcttacaacagcatcctttgggtggccaccgttgaggattccctctccgcctatctcactaacggagataacgtcattcagcccactacttctactaccactaccacggttgcaccaaccacagttactcagccccctatcacggaaccgtccactccatctctgccagtaccagtgaccgacggagcaatgacgagcttcgcatcactcttcatcatttcattgggtgccattttgcaccttattttataa

SEQ ID NO: 85 - DNA, 2856 bp, Helicoverpa zea
atgggtgccaaaatgttgcttcccaccgtattttgcattctcctgggatccatagcggccattcctcaagaggacttcaggtccaacttggagtggtctgactacagcaccaacttagacgaaccggcgtaccgtctgcgtgatgtggtctatcctactgatgtcaacctggatctggatgtctacctaaaccacctgaacttctctggacttgtacagattgatgttcaagtacgagagaacaatttacgccaaattgttcttcaccaaaaggtggtttccatcaccggagtgaatgttgtcggacctaacggcccagttcctctccagttcccccatccttacaccactgatgactactatgagatccttctcatcaacttggaccagcccatcagcattggcaactactccatcaccatcagatacaatggccagatcaacgctaaccctcttgaccgaggtttttacagaggctactattacctgaacaatgaattgagggtctacgccaccactcagttccagccttaccacgccaggaaggccttcccttgcttcgatgagccccaattcaaatcccgctacactatctccattactcgcgacaccagtctgtctccatcgtactccaacatggctattagaagcgcccaagacgttagtacctcccgtattcgcgaaaatttctacactactcctatcatctccgcctatctggttgctttccacgtcagtgacttcgtctccactgaatacaccagtaccgatgccaaacccttcagtattatctcccgccaaggtgccacgaaccagcaccaatatgctgctgaaatcggtcttaagatcaccaacgaactcgatgactactttggcatccagtaccatgagatgggacaaggtgctttgatgaagaatgaccacatcgctcttcctgacttcccctccggtgctatggagaactggggaatggtcaactacagggaagcctacctcttgtacgacgcaaacaacaccaacttgaacaacaagatcttcatcgctaccatcatggctcacgaattgggacacaaatggttcggtaacctcgtcacttgcttctggtggagcaacctttggcttaacgagtctttcgccagcttcttcgaatacttcggcgctcactgggctgatcccgctctagagttggatgaccagtttgtcgttgactacgtgcacagcgctctcaactctgatgccagccagtacgccactcccatgaaccacaccgacgtcgtggacaatgactccatcacctcccacttcagtgttaccagctacgctaagggagcttccgtccttaagatgatggaacatttcgttggatggaggaccttcagaaacgctctcagatactacttgagaaacaacgagtacgacatcggtttccccgttgatatgtacacggctttcaaacaagcagtcgctgaagattttactttccaacgtgacttccccaatgttgacgttggcgcagtattcgacagctgggtccagaaccctggatctcccgtcatcaatgttgcccgtaacaacaacacaggtgtcatcactgtcaaccagcaacgttacgtgctttctggcgctgttgccccaacgacgtggcacattcctctcacctggactcaacatggctccctcaacttcaacagcaccaggcctagcaccgtccttaccaatgagattggcaccatcaacgctgcatctggagaccacttcgtcattttcaacattgcccaatctggtctgtaccgtgtcaactacgacaccaacaactggcagttgcttgcttcatacctgaagagcaacaacagacagaacattcacaagctgaacagagctcagatcgtcaacgacatcttgtacttcgtgcgttccaacagcatcaacaggactctcgcttttgatgtcctcgacttcttgagggatgagaccgattactacgtatggaatggagctcttacccagatcgactggatccttcgtcgccttgaacacttgcctaccgctcatgctgctttctctgaatacatcctcgagctcatgaacacggttatcaatcaccttggctataacgagcacagtaccgactctacctccacaatcctcaaccgtatgcagatcatgaactacgcctgcaaccttggacacagtggctgcatttctgacagtttagacaaatggaggcagcaccgtgcgaacgtatctaacttggtaccagtgaatctccgtcgttacgtgtactgcgttggtcttcgtgagggtaacgaaactgactacaactacctgtacagcgtgtacaattcttcagagaacactgctgacatggttgtcatccttcgcgctctcgcatgcaccaagcatcagccttctcttgagcactacttacaacagtccatgtataacgacaaagtccgtatccacgaccgcaccaatgcattctccttcgctctgcaaggcaaccctgagaaccttcccatcgttctgaacttcctctacaacaactttgccgccatcagggaaacgtacggaggtgttgcccgtctcaatatttgcctcaacgctattgcggcattcttgactgactaccagaccatcactcagttccaaacttgggtggactccaaccaattggagctggttggctctgtcagcgttggaaataacgtcgttaccgccgccttgaacaatctcacttggggcaacggcgcagctgttgaaattgtcaacttcctcaactctagaagcggttccaccaccatccttgcctcttcaatcctcatcttagcagccatgcttctacaaatgttccgctaa

SEQ ID NO: 86 - DNA, 1608 bp, Helicoverpa zea
atggtgacactgttcccgtacgtagtggcggtgctgtgcggcgcgacgagcgcgcgcgcccactggctgcatcccgcggcgccggccgccgccagccgcgccgagacctctgccaactactgggcgcaagacgcgcaggccgccatcaacgctcgcctggaacgagttgaaagcgtgaagaaagcgcgtaacgtcatcatgttcctgggcgacggcatgtcggtgcccacgctcgccgccgcgcgcacgctgctcggacagcgccaagggaaaacgggagaggagacaaagttgcatttcgagactttccccacaatcggattagtgaagacgtactgtgtggacgctcagattgcagactccgcatgtactgccacagcgtatttgtgtggtgtaaaaaataactatggcgccataggcgtagacggcacggtacgccgaggagactgtcaagccgcttcaaacactgcgacacacgtcgagtccatcgcggagtgggcgctcgctgacggacgagatgtcggtattgtgacgacgactcgtatcactcacgcgtctccggcgggcacgttcgcgaagacggcgaaccgcacctgggagaacgacggtgaagtgtcgcagatgggcttggacgccaaggactgccctgacatcgcgcatcagttggtacaccatcatcccggtaacaagttcaaggttatttttggtggtggcaagcgtgcctttttgccaaatactgaacaggacgaaaaacgatcttatggtagaaggatagataaccggaatcttatcaaagagtgggaggatgataaggtttctcgtaatgtcagccatcaatatgtttggcaccgcgagcagctaatgcgtctaaaggaggacctgcctgaatacatgttgggactgttcgagagcagtcatatgacctatcacttgaaatcagaccctcagtctgaacccactctcgctgaactaacagaggtggcaattcggtcattaagacgcaatgagaagggattcttcctgttcgtggaggggaggcgcatcgaccacgcgcaccacgacaacctggtggagctcgcactcgacgagacgctggagatggacaaggccgtggccaccgccacggagatgctctcagaggacgactcgctcatcgtggtcactgccgaccacgcacacgtcatgactttcaatggctactctaaccgtggtcataacatcctcgggccctccagggatgtcggactagacaatgtgccttacatgacgctaacgtatgccaatggacccggattccgtccacacgtaaacgacattagaccagatgttacccttgagccaaactatcgcactctggactgggagtcgcacgtggacgtgccgctggtggacgagacgcacggcggcgacgacgtggccgtgttcgcgcgcgggccgcaccactccatgttcacggggctgtacgagcagagccagctgccgcacctcatggcctacgccgcctgcatcggccccggccggcacgcctgcgccagtgccgcgcacttgcctagcgcgcacttcgtcgtagctctgctcgctctattcacttccattttactgcgatga

SEQ ID NO: 87 - DNA, 1605 bp, Helicoverpa zea
atggtgacactgttcccgtacgtagtggcggtgctgtgcggcgcgacgagcgcgcgcgcccactggctgcatcccgcggcgccggccgccgccagccgcgccgagacctctgccaactactgggcgcaagacgcgcaggccgccatcaacgctcgcctggaacgagttgaaagcgtgaagaaagcgcgtaacgtcatcatgttcctgggcgacggcatgtcggtgcccacgctcgccgccgctcgcacgctgctcggacagcgccaagggaaaacgggagaggagacaaagttgcatttcgagactttccccacaatcggattagtgaagacgtactgtgtggacgcccagattgcagactccgcatgtactgccacagcgtatttgtgtggtgtaaaaaataactatggcgccataggcgtagacggcacggtacgccgaggagactgtcaagccgcttcaaacactgcgacacacgtcgagtccatcgcggagtgggcgctcgctgacggacgagatgtcggtattgtgacgacgactcgtatcactcacgcgtctccggcgggcacgttcgcgaagacggcgaaccgcacctgggagaacgacggtgaagtgtcgcagatgggcttggacgccaaggactgccctgacatcgcgcatcagttggtacaccatcatcccggtaacaagttcaaggttatattcggtggtggcaggcgcgcctttttgccaaacacagttcaggacgacgaagggtcttatggtaggaggatagacaaccgcgaccttatccaggagtggaagaatgataaggattctcgtaatgtcagccatcaatacctttggcaacgtgagcaattaatgaacctgaatgatgacctgcctgagtacatgttaggtctgttcgagagcagtcatatggaatatcacttgaaatcagatcctcagactgaacccactctcgctgaactaacagaggtggcgattcgatcattaagacgcaatgagaagggattcttcctgttcgtggaaggggggcgcatcgaccacgcgcaccacgacaacctggtggagctcgcactcgacgagacgctggagatggacaaggccgtggccaccgccacggagatgctctcagaggacgactcgctcatcgtggtcactgccgaccacgcacacgtcatgactttcaatggctactctaaccgtggtcataacatcctcgggccctccagggatgtcggactagacaatgtgccttacatgacgctaacgtatgccaatggacccggattccgtccacacgtaaacgacattagaccagatgttacccttgagccaaactatcgcactctggactgggagtcgcacgtggacgtgccgctggtggacgagacgcacggcggcgacgacgtggccgtgttcgcgcgcgggccgcaccactccatgttcacggggctgtacgagcagagccagctgccgcacctcatggcctacgccgcctgcatcggccccggccggcacgcctgcgccagtgccgcgcacttgcctagcgcgcacttcttcgtagctctgctcgctctattcatttccattttactgcga

SEQ ID NO: 88 - DNA, 3888 bp, Spodoptera frugiperda
atgctgacttttatggaagtcccgagaaagcgcactatggtggaggccggaagcctggaagagagattcagactcatccccacctccacgaatacaacaccaaacaaggatagtaaaggaaacgcctggcagctgaagcccggcgaaaaagagaatgaaaataagctgcccgatcctctcaacgaagacgtgcaaaagggtcagttctccgacacttctagcgaaccaagcgaagctaaagccgaagaggtgcccagcattcctttcattacactgttccggttcgcctctaccagagataaactcttcatcatatgcgccctcatttgctccgctgtggccgctgtcagcacgcctcttaatacacttctgctggcttacctgcttgaggccatggtcaactattccatttttggtgacgccgacgccttcatgaagtcccttctgaattttgctatttacaatgccgccgtcggcgccgcactggtggtgctcagttatgccgcaaccactctgatgaacatcgcagcatataaccaggtgtacgtgatcaggcaggaatatctcaaggccgcactcaaccaggacttcggctatttcgacgtgcacaagaatgcagaaattgctaacaagatgaacagcgacataatgaagctcgaagagggaataggtgagaaactcgcaactttcttcttctaccaagcaagcttcctgagttctgtcataatggcactggtcaaaggctggaaacttgcccttctgtgcttgatctcatttcctgttactatgactctggtgggtgtcgcaggtctgatcgctgcctctctgtctaaaaaagaggccatcgccaccgggaaagccggcgctatcgctgaagaggtgatctctgctattcggaccgtgtacgccttcagtggtcaagagaaagagctcgaccggtacgagggccacctcaatgacgcccggaaaatcaacgtgaagaagagtctgttcaacggcctcgccatgggctgcctctttttttgcatcttttgcgcttacgccttgagtttttggtttgggtatagactcatggtgactgacggatatgacgtgagcacaatgattgccgtgttcttcggcgtgatgacaggctctgctaatttcggtatttctagtacgctgatggaggtgttcggcagcgctcggggagccggggctcacatcttcaatatgattgataacgtgcccaccatcaaccccctgcagaaccgcgggaccgtcccgtccgacattgagggaaacattgagctgaagaatgtggaatttcactatccgtctagacccgatgtgcccgtgctgaagggagtctccatcaaagtcaagcggggccagagcgtggcactcgtcggacattctggatgtggtaagtccactatcatccagctcatctcacgcttctatgatgtcgttgagggatctgtggctatcgacggaaatgacgttcgggacctctcagttagatggctccgcgagcaaatcggtttggtgggccaggagcctgtgctcttcaacactactgtccgggaaaacatcaggtatgggagagagaacgctacaaacgaggagattgaagcctgcgccagacaggctaacgcacaccagtttattatgaagttgcccaaagggtatgatacgctggttggtgaaaggggggccagcctctcaggaggtcagaagcagcgcatcgctatcgctcgcgctctcgtcaggaatcccaagatcctgctgctcgacgaggctacgagcgcccttgacacctcctcagaggcaaaggtgcagaaggccctcgacaaggcccaagaaggccgcacgactatagttgttgcccacagattgagcaccatccgcaatgtggatgtgatttatgtttttaaggcagggctggtcgtggagtgcgggaatcacaccgagttgatggctagtaagggacactattacgacatggtcatgctccagaacctccccggcgttgacgagcagtcccctgagaagactaaactcagtagggaaacttcaatcatctcagaaaaggacgatgaagacgaatttctcgaatttcggaatgatgacaaggaggaggacgctgccgaggctccggacatctcctttatgcgcgtgcttaagctgaacaagccagaatggaagtcagttacgctggcttctatttgctctctcatgtctggtttttgtatgcccctcttcgccgttatctttggcgactttctggctctgttggatggggacgaccctgatgaaattcagaaaggggtcagtaggttggccctgatatttgttggaatcggtgtgttctcaggtatcactaactttattgttgttttcttctatggcattgctggggaggctctgacgaagagactccggctcatgatgttcagaaaactccttgagatggacattggtttttacgatgacaaggataacagcactggagccctgtgtgctcggttgagtggtgaggccgccgccgttcagggtgccacaggccaacgcatcggcactgtggtgcaggctgttggaacctttggatttgccctggtgctgagcctcatcttcgaatggcgggtggggctggtcgcactgaccttcgtgcccattattatctttgttctctataaagagggaagaatgacctatgctgccacatccggcacagtgaaggtcatggagacctccagtaaaatcgccgtcgaagcagtcgctaatgtccggacggtcgcttctctgggtagggaggagacgtttaggcgggaatattcaaaacagctccggcccgctctcgacacagccgtccggagcagccactggaggggactcgtttttgggatgtcccgcggggtgtttaactttgtgatcgcttctagtctgtattacggaggcactattattgtcaatgagggtgtgccctttgagcaggttttcaagagtgctcaggctcttttgatgggagccacttccgctgctcaagctttcgctttcgcccctaactttcagaaagggatcaaagccgctggtcgggtgatcgtcctgctgggtcgccagagcaagatcacagatccagccgaaccagctgtgaagcacttcaacggcacaggcgaggcttctctccaggggatacagttcagataccccacaaggcctctggtgagagtgcttaaggatctgaacctcgaaatacagcggggaaaaacggttgcactggtgggggcctccggctgtgggaaaagtacagtcattcaactcctcgaacgctactacgacccagaagacggtatcgtggcacaggacggagttcctctgcccaagctcaacctcgtcgatgcccgccgggcaatcgggttcgtgcagcaggaacccatcctgtttgatcgcacaatcggagaaaatatcgcctacggaaacaacgaagccagagtgtccaatgatgaggttattgaggcagccaagcaggccaatattcacaactttataaccagcctgcccctgggctacgatacaaatatcggatcaaaagggacgcagttgtccggaggtcagaagcagcgggtggccatcgcccgggcccttattagacggccaaaaatgttgctccttgacgaggcaacttcagccctggacaccgagtctgaaaaggtggttcaggaagctctcgataaggccaaggccgggaggacctgcgtgatgattgctcacaggctctccacggttagagatgctgacgtgatctgtgtgatacatgagggtcaggttgctgaaatgggcacacacaacgaattgctcgaactgaagggtctgtactataatctgaatcggagaggttatgcttaa

SEQ ID NO: 89 - DNA, 3918 bp, Spodoptera frugiperda
atgggtacaaagaaaaagaaggagcagaaaaaggaacctgaacagacccttagctactaccagatctttcggtatgccacctgtaccgagttgatggccacgatcctcggcatcatttttggcctcgcctctggtggaggcgtttgctacaatctcgtgcagatcggcgaactcagcactgcattcgtggaaaggactacctacacggagcgcttgacatcttatcttcccctgaccgccgccttcggtggaggcagacgcctgtttaacgcttcttatgaagaaaatatgctggccctcatagaggacgcaaaggctatggccataggcctctttctgtccattggagtttcactgatcttttgcatgttgagcgtcggtctgatctcctggtccgccctccgccagattacgcgcatcaggatgaagtttctcaatgccgtgctgaggcaggacatgtcatggtttgataccgattctgagtttaacttggcatccaaaatgtcagaaaacctcatgtcactgaaagagggaatgggggacaaactggccgtggtgagcaatctggtcggtaccgccataatttgtctgtgcacagcctttcctcttgggtgggagttgactctggcttgcgtgtccgtgatgccgttctctatcgctgtgagtattatcctgactaattaccagacaaagagttcaattctggaaatggagagttactctcaggccggaaaacaggccgaagaagtcctcaagtctgtgcgcactatcgttgccttcaacggtgaaaataaggaagtggatagatacacaaagctgctgcagccagccgaaaaacagggtcggaagcgcggactgtacacaggattggggaatggcttcaactgggtgttgacttactctctgaacgcaattggcttcacatacggcactagactggtgtttatggactgggacagccccgacggcgagaggaagtatcttgttggcgtggtgtattccatcctgttctcagtctacatggctactcagagtgtgaccttctgcgtgcctcatgccgaggtcttcgctgccgcccgcggcgccgcctcaagcattttccagctgattgacagagtcccgctcatagacagcctgcagaagggcggactgacaccccggagagtcatcggcgacatctccctcgaagacgtgcacttctcctacccgagccggcccgaggtgaaggtgctgaatggcttttccataaagattaaagctggcgagtgtgtggcactcgtcggaagtagcggctgcgggaagtcaaccattctccagctcctgcagcgcctgtatgatcctttgagcggaagtgtcaagctcgatggaaaggatgtcaaaaacctgaacctggggtggctgcgctcatgtctgggcgttgtcggtcaggaaccggtgctgtttagggggactatttttgagaatattgcaatcggtttccctgaggcaacgcgggaagaagtccaaacagtggccgaaatggcctatgctcacgacttcattaccaatctgccaaacggctacgacacagtgatcggcgagcggggagccagcctgtccggcggtcaaaaacaaaggattgccatagccaggtcactcctgagagagccggcagtcctcctgctggatgaggctacctcagctttggacccgcatagcgagcggcaggtgcaggcagcactggatcgcgccagcgtcgggaggacaaccattatggtgagtcatcgcctgtccaccataacgaatgccaacaggattatttgcatggatcagggtgccattgtggaagagggcacacacgaggagctcatgaaaacaaagggtttctactataagctggtcactacagggacggaaacaaaagagcctgaagaaatcgaaactgttgccgaggaaggcgatggagaggaaaacggagaaccagtgttggcccctcgcgccgatgtgaagagaaagtcaaatagacgcgtgcaccggcaccattccatcaagaaggatagccacgactggatgacgcctcggggctctatttgttccgtggtgtcaaccggcctccagaacttcgtctacaatgctgattacgagtctgatgaggaaaaggacgaggaggaggaggttaaaccagtgagtgactggcagattctgaaactgaacgcacccgagtggcctctgataaccgtgggctccatcgctgctttcatccagggagcttgctttcctgtgtttgccctcttgttcggcttctcctccggcatcttcgtgctcgacgaccggaaagagatcatctatctggctgatctttatagcggcatgtttatcgtggtggccgcagttgctggggtgtcaatgtgtctccagtcaaccactttcaccaccgccggtctgaagatgaccacgcggttgcggcagcaatatttttccagtctcctcaaacaggaaatcggattttttgacaaggagagcaataccgtcggggccatgtgtgcacgcctgtctggcgacaccgccgaggtgcagggcgcaacaggcctgaggatcggcctgatcttgcaagggatcagctccgtgttggtgggattcctcatggccatatgctacaactggaagttgactctggtgggtaccgtgttccttcctctcatggtgggctctatttggctggagggaatcgtttcccaacagtcacagatcaatgagaggactgctatggaggccgcaaccgccatagccaccgaggccgtggtgagcatcaagaccgtgcagtctctgggtgtcgagctcgtgtttctgaagaagtttgaagaggcccttaacgaggcctgcgccgcagtctcaaaaaaaacaagatggcgcggtcttgtccttggattgggggtttacgtgccatttatggcattctgctctgccaccgtctatggcgctgtcctcgtcgcctacggtgagatagagtacaagatcgtcatgctggtgaacgaagcaattatgtatggagcatatatgctgggtcagtccctggtgtacgtcccgtccttcaactctgcaaaaacttgtggagctcgcatcctcgccctgatcaaaaggacacccagggtgaaaacggaggacggcattcgcgataagaaggactgggctgccaccggcaactttagcatcagagacgtcgaattttcatacccaacacggccacacctgcgcatcctcaaaggtatagacctgaaagtggatgctggcaagacagtggctcttgtcggctcaagcggttgcggcaagtccactgtcctgcagctgatgcaaaggttctatgacccggactccggcaacattgaactggactcccgcgacatccgcagcagcctcacacttccacgcctgaggaggcaacttggcgtggtgcagcaagaaccaattctgttcgatcggactttggcagagaacatcgcctacggtgacaacaaccggaaggtgacaatgcacgaaatcgtggccgcagccaaagccgcaaatattcattcatttatagtgagtctcccgaaaggctatgatacaaatctgggatctgggggtgcacagctgtctggaggccagaagcagcgggtgtgcatcgctcgggcccttatcaggagcccccgccttctgctgctggacgaggcaactagcgcactggacgctaattccgagagggcagtctccgaggccctcgaaaaggccgccaaaggccggacatgcataactatcgcccatagactgagcactatcaaggatgccgatctgatctgtgtgcttgataaaggcaagatcgtcgagagaggcacccacgcagaattgttcaaccagaggggctactactggcggatgtgtaagggacagaacatggcctaa

SEQ ID NO: 90 - DNA, 3801 bp, Helicoverpa zea
atgaaagatagcgatggaaacggaagacagctgaagcccggcgataaagagaacgggaataagctgccggaccccctcaatggggagttcccgaaaggcaaagattcagacaccagcagtgaggccgatagtaaagccgacgaggtgccctcaatagcctttattactctctttcggttcgccactaaaaaagataagatcttcatcgtgtgtgccctgatatgtagcgtggtggccgcctgttccacacctatcaatacgctcctcctggcctttcttctggatgccatggtcgagtatgggagtagcatacgggatggtacgcccgacccagacacatttctcgaagccctgatgttctttgctatatacaacactgttaccggtgtggtgctgatcatcctctcttatgccgcaaccgtcctcatgaatatcgcagcctaccatcaggttcatgtgattagacaagagtaccttaaggccgctctgaatcaggacttcgcatattacgacattcataaaaatgccgatatcgcttctaaaatcaactctgacgttgtgaagctcgaagacggcattggagaaaagctcgcaactttcgttttttatcaggccgcattcttctctagcgtgatcatggctctggtgaagggttggaaattggcactgctttgcctgatctccttcccagtcaccctgactcttgtcggtgtcgccggactcgttggggctcggttcgggaagaaagaagccattgccagcgggaaagccggcgcaattgctgaagaggtcatttccgctatcagaacagtttacgctttctccgggcagagcaaagaaatggtgagatatgaagggcatctcagagaggcccggaagattaacataaagaaaggatttttcaatggtctggctatggggctgctgtttttttgcatcttctgcgcatacgcactgtccttctggtttggatacagattgctctccactgatgacgactacgacatcagcactatgatcgccgtgttcttcggtgtcatgactgggtccgctaatttcgggatttccagcacactgatggaagtgttcggctctgcccgcggcgcaggggctcagatcttcaatatgatcgacaatattcccactattaacccgctgctcaatcgcgggactaccccaccgaatatacaaggaaatatagaactgaagaacgtcattttccactatccatcccgcccagatgttccagtgctgaagggaattaacatctcagttaagagaggccagtccgttgcactggtgggtcattcaggatgcggcaagtctacgattatccagctgatctcccgcttttacgatgtcatcgatggcagtgtcgcaatagacgggcacgacgttagggatcttagtgtgcggtggctgcgcgatcagattggactggtcggccaggagccggttctgtttaacacaacagtgcgggagaatattagatacgggcgcgagaactgtaccaatgaggagatcgaagcatgtgctaggcaagccaacgcccatcagttcatcatgagactgcccaagggatacgataccctcgtcggagagcggggagcatccctgtccgggggacagaagcagagaattgccatcgcacgcgctctcgtgagaaaccctaaaattcttttgctggatgaggctacctcagctctggacactagctccgaggcccgcgtgcagaaagccctggacaaggcccagaagggccgcactacactggttgtggctcaccggcttagcaccattcgcaacgtggatgtgatatacgtgttcaagtcaggcgtggtggtcgagaggggtaatcacgatgagcttatgtctcaaaagggccactactacgatatggtgatgctccagaaccttggtgctgaagacaccaatgacaagtcaaggcttatgcgcgaaactagtgagacctcagtggaggacgaggaggatgaggaggagttcctcgattttaagaccggtgatacagaggatgacgtcgataacgtgccagatatttccttttggagggtgctgaggctgaacaaacccgagtggaaatcagtgtccctcgcttcaatttgcagtctcatgtctggattttcaatgccgttgttcgccgtgatttttggtgattttctggctatccttagcgacccggaccccgctgtcgttctgaatgaagtgaggaagatagcactcatttttgtgggaatcggcgtgttctccggaattacaaacttcatcgttgtctttttctatggcatagccggagagtacttgacagagcggctgaggcagatgatgttcaagaaattgttggagcaggaagtgggattctatgacgacaaagataattctacaggcgccctgtgcgcccgcttgtccggagaggcagcaactgtgcagggagccacgggccagcggatcggcaccgtcgtgcaggcagtcggaaccttcggattcgcactggtgttgtccttggtttatgagtggagagtggggttggtggcactgacatttgttcccgtgatcgtgtttgtgctctacaaacagggcaggatgacctacaaggcctcatttggcaccgctaaaactatggagaagtcctcaaaaatcgctgttgaagccgtggccaatgtgaggacagttgcatccctgggtcgggaggacacctttcgccgcgagtacgagaagcagttgaaccctgcactccaggaggcaattaaggcatctcactacaggggcttggtgttcggcctgagcaggggtatctttaattttgtgattgcagccagtctgtattacggcggcacacttatcgtgagcgaagatatcccctatgacgtggtgtttaaaagcgcccaagccctccttatggggtccagttctgccgcccaggcatttgcattcgcacccaattttcagaagggcatcaaggccgctggtcgcataatcatgctgttgaatcggcagtctaagattaccgaccccgtgcggcccgccgtccataatttcaagggaacaggtgaagcatccctgcaaggcataaagttttgctatcctacccggcccatgattcaggtgcttaaaggcctgcagctcgaaatccaacgcggaaaaacccttgccttggttggcgcctctggctgtggcaagagtacggtgattcaacttctggaaagatattacgacccagacgaaggcatcgtcgcccaagatggagttcctttgcctaagctgcgcttggtggacagccgccgcgccattggatttgttcagcaggagcctatccttttcgacaggacgataggggagaacattgcttatggaaacaacgagcagaaggttacccaggacgagatcatccaagctgccaaacaggccaacatccataacttcatatcatcactgccgctgggctatgacactaatattggtgctaagggtacacagctgagcggaggacaaaaacagcgggttgccattgcacgcgccctgatcagacgcccaaaaatgttgctcttggacgaggcaactagtgcactcgatacagaatccgagaaagtggtgcaagaagccttggacgctgcaaaggccggaagaacatgcgtcatgattgcacatagactttccactgtcagggacgctgatgttatatgtgtgattcacgatggcttggtcgccgagacgggtacacacaccgagctcatagaaaggaagggcttgtactacaatctgaaccggagaggttacgcctaa

SEQ ID NO: 91 - DNA, 3783 bp, Ostrinia nubilalis
atgaaaagcaaagtctacgatttgaatggcaccggaaaggaaaaaaacgggggactccctacccccgacttcgtgcccaaggacaagaaaaacaatgacagtgagccagaacctacgcctgaggaggttcctagcgtgagtttcttctcactgtatcggttcgctaggacacaggacaagtgctacattgccgtcgggatcatttgttctattcttagcggatgctgtacacccttgaataccctgttgttcgctagcttgctccagagcatggtcgactacggtattagtctgcagatagggcagcccgaccccgactctttcaagactgcatttactgagtttgctatctataattgcattgtcggagctgcccttgtcattctttcttataccgccaccgtgctgatgaatattgccgcctataatcaagtgtacaaaataagacaagaatatctcaaagcagcactgaaccaggacttcaagtactttgacgtgcaccaaactggcgactttgccgtgaagatgactaacgacttggtcaaacttgaggacgggataggggagaagctgggcacatttatcttttatcaggcagcttttgtgagctctatcatcatggcattggtgaaagggtggaagctggccctcttgtgcctgatttcattcccaattactctcactcttgtgggcctcgccggctttatcgcttccaagctctccaagaaagaggcagtggccgctgggaaggccgggtcaatcgccgaggaggtgattagctctgtccgcaccgtctacgccttttcaggccagcagaaggagattgatcggtatcagttgcacttggccgattctcggaaaatcaatataaagaagggcttctataatggtgttgcaatgggtgtgctttttttttgtattttttgttcttatgctctttctttttggttcggttataaactgatggtggaagaacctgagaattacgatgtgtatacaatgatcgccgttttcttcggggtgatgatggggtccgctaatttcgggatttcaagtacactgatggaagtttttggctccgcaaggggcgctggagctcagatctttaatctcattgacaacgtcccaacaattaatccactgttggacgctggtaccaagccacctagcattgacggtaatatcgagcttaaggatgttgtctttcagtaccctagtaggccagacgtccccgtgctgaaaggtgtgtcattgaaagtgagcaggggacagagtgtggccctggtcgggcacagcggatgcggcaagagcaccatcatccaacttatttcaaggtattacgatgtcgtgggagggagcgtgctcgtcgacggtaaggatgtgcgcgagctttcagtgagatggctgagggatcaaatcgggctcgtggggcaggaaccagttctgttcaatacaaccgtcagacagaacatccggtacggcagggaatccgttacggatgaggaaatagaagcagccgccagacaagcattcgcccatcagttcatcatgaaactgccaaagggttacgataccctcgtgggagagaggggagcttccctgagcggggggcagaagcagcggatagctatcgccagggcactggtccgcaatcccagcattctgttgctggacgaagcaacaagcgctttggatatggcctccgaggcaaaagttcaaaaagccctggataaggcccaggagggaaggactacaatcgttattgcacatcgcctgagtacaatacgcaatgtggacgtcatttacgtttttaaaaatggcacaatcgtggaatccggcaaccatgaggatctcataaaggccaaaggtcactattatgacatggtgatgatgcagaccttccctggtagtgaggacgacgctgaaatcgtgaaacagctgacgagggaggtctctgtgattagcgaaaaggacgatgaggaggagattgtcggaggctccgggggggaggtggtggaggcagaggaagaaaacaccgaagtgtcattttggaaggtggtcaagctgaataaacctgaatggaaatcagtgtcactcgctagtctgtgttctttcgtgagcggattttctatgcccctcttggctgtgatcctgggagactttattaatgtgctgtccaaccccaatcctgatgaggtgcttccggaggtgcgcaggttcgccctcatctttgtgggaataggggtgttcagtggcatcacaaacttcattaccgtctttttctacgcaatagcaggcgagtacttgaccgaacgcctgcggaaagtgatgttccatcatatgctgcagcaagagatagccttctacgacgataaaaatcactcaaccggcgcactctgtgctaagctcagtggcgaggctgctcaagtgcaaggtgccactgggcagcggataggtaccgttctgtcagctatcgggacctttgggtttgcactggttctggctttgatctatgagtggagggtggggctggtcgctctggcattcgtgccgctgatggctggcatcctgtataaggaaggtcgcatggtttctgctgaatcattcggtaccgccaagactatggaggccagttccaagatcgctgtggaagccgtgtctaatgtgagaaccgtggcaagcctcggcagagaaggccaattcttgaaggactatgctacgcaactcttgccagccctccatctcgccaaaaggagcgcacactggagggggattgtgttcggcctgagccgcggactgttcaacttcatttatgctgccgccatgtattacggaggtattagaatcatctactatggcgtggattttgctctcgtcctgaaatcagcccaggcactgctcatgggggccagcagcgcagcacaggcctttgcatttgctcctaacttccagaaagggattaaagccgcagggagagttaccgggcttctcaataagaggtcaaagattactgacccagctaaccccatcgagaactttaaaggcaccggagaagccagccttcaggaagtcaatttccggtacccgacccgccccctgatccaggttcttaagaaccttaaccttgaagtcgagaggggtaaaaccgtcgcattggtgggctcaagcggctgcggcaagtcaacagtgattcaattgctggagagatactatgaccctgatgacggcatcgtcgctcaggatggcacaccactgcctaaattgcggcttgctgacgccaggaaggccatcggctttgtgcagcaggagccggtgctgttcgacaggacgatcggcgaaaacatcgcatacggagataattctcggagagtcgtgatggatgagatcatccacgccgcacagcaggcaaacattcacaatttcatcacctccctgccactcgggtacgacacaaacatcgggagcaagggcacccaactgtccggaggccaaaagcagagagtggctatcgccagggctctggtgcgccggccccaaatgctgctgctggacgaggctacttctgcactcgacacagaatccgagaaggttgtccaggaagccctggacgctgccaaagcaggccgcacttgcgtgctgatcgctcataggcttagtacagtcagagacgccgatgtcatttgtgtcctctccgagggaagggtggccgaaagcggaactcatgccgagctcctgcagttgaagggcctctattacaatctgaacaagtctgggtatacataa

SEQ ID NO: 92 - DNA, 1698 bp, Trichoplusia ni
atgaggtcgatagttacgttgctggtgttggtggctgcttgcggcgcgctcgccgaccgctaccaccccgctgagcccgctgagcgcgccgggccggccggccgcgcctcgcccgccgagctgctcggcagccactggcgggcgcaggcgcaggacgcgctcaaggagcgcctggcgcgccccgccaaccgcaacaaggcccgcaacgtcatcatgttcctgggcgacggcatgtccgtgcccacgctggccgctgcgcgtgcgctgctcggacagcgacagggcgccaccggcgaagaagcacagatgacttttgaaagtttccccacttccggtttaagtaagacgtattgcgtgaactctcaagttgcggactcagcgtgctccgcgacggcgtatttgtgcggcgtcaaaacaaatcaaggcttactcggagtggacgcgagcgtgcagcgacacaactgcgagtcatccatcgacaccgcccgccacgtggagtctatcgcggagtgggcgctcgccgacggcagagatgctggtattgtgacaacaacccgcattactcacgcgtctccagccggcgtgttcgccaagacggcgaaccgcaactgggagaacgacgcagaagtaaaagcggcgaaccaagacatcaacgcctgccccgacatagcttaccaactaatacacaaacatcccggcaacaagttcaaggttattttgggtggtggcaggcgcaacttcttgccaaccacagtgacagatgaagaatcgcaagccggcagaaggactgatggtcgaaatttaattgaagagtggcaacaggacaaagctgcccgtggtgtctcttttaagtacgtttggaacgtcagtgagcttctgcaactgaatgataatctgccagaatatttattaggattgtttgaaagcaaccatttgcagtatcacatgcaagcgaatctcaacactgagcccacacttgagcaactcacggaaactgcaatccgcatgctgaaccgaaatgagaagggtttctttttattcgtcgagggcggtcgcattgaccacgcccatcacgacaaccttgcgcacttagctcttgacgaaactcttgaaatggataaagctatcaagcgcgccgttgatctgctctcggaggaagatactctaatcgtagtaacagccgaccacgcccacgttatgtcgtacaacgggtactctcgacgaggtaatagcattcttggaccctcaagagacactgacgaaaataatgtgccgtacatgacgctatcgtacaccaatgggcctggtttccgtccacatgtcaatggaaagcgatccgatgttacccaagagaacggatttggcactttgacgtggaaatcgcatgtcgacgtacccctagactcggaaacacacggcggtgatgacgtggcagtgttcgcgcgcggtccttaccatatgcttttcacggggctgtacgagcagaatcagataccccaccttatggcctacgccgcctgcatcggtcccggcctgcactcgtgtgccgaggccgacaccacctccacgccagaggcgaacccttcagaggctactaccgccagcccaacgaccgctgaaccatcagctgcggcgcctgtcagcgctacgctcgcactttttgctctactcactactcttactttgttattacactaa

SEQ ID NO: 93 - DNA, 2949 bp, Trichoplusia ni
atggcaaatcgcttcacattgctccttttgggggtggccctggcccagggcatccttgcctatagtcccatcgagatgccagaggacgaatggcaggaatacaggaatttaatgagggatcctacgtatagactagtacgaacaaccgaacctgaaacttataaagtgactctgacgccatactttgatactaatgacgcgaaagctttcactttcgatggagaagtggagattctcataaaggccaatcaagctgtttcagagatcgtgctacactgcaacgatttgactatttcaaaattgactgttactacggagacctccacaactgatttggccgaagccggtcaaaccttcacttgcgaagcaaatactagctttttaagaataaaaactacgtcacctttggaggctgaagctaaatacgtcataaagagcgaatttacgggtaatctccaaactaacatgagaggtttttacagaagttggtatgtcgacagcagtggtaataagagatggatggctacaactcaattccaacctggtcatgcgcgccaggccttcccttgctacgatgaaccgtctttcaaggccttattcgatattaccatcaagcggctaccggacttctctgaaaccctatcaaacatgccaatcaaaacaaggggaccgctcactgatggtagaattgctgaaaccttccacactactcctaaaacctctacgtatttgcttgcgttcattgtttctcactacaaggaggttgctactggcaccgacctcaatagaccctttaagatctatgctcgtgacaatgctaaactcaccggagattggtctttggatattggtgaacgtcttctcgaagagatggagaagatcacagatgttccatactacggaatggctctaaacatggatatgaaacaggccgccatccctgacttttctgcaggagctatggaaaattggggtcttttgacatacagagaagccctcattctttacgatcctaaacattccaaccatttctacaagcaacgtgtagccaacattgtgtctcatgagattgctcacatgtggttcggaaattacgtcacttgcgcctggtgggacaacctgtggctaaacgaaggattcgcgagattctaccaatactacttgacagacagggttgataaaaatttaggctttgatactcgtttcatcgtggagcaactgcacacgtcactgctttccgactctggtgttaacgctcatcccttgacagacgagaatgtgagcagcccaacaactgtcagcgctcatttctcaaccatcacctacgccaaaggagcctctgtactcagaatgacgcagcacttgctcggtaactcaacttttgagaaaggtcttaggagctatctgaaagcaaggagatatgatgtcgccacacctgatgacttgttcgacgcacttcaagaagctgcaacattggatggagccctgacccagtatcctggtgccactgttaaggcctattttgaaacttggacatcaaaagctggtcacccgctactgacagttactgttggtaacgatggaactatgaaagtaactcaggaacgctttggactcactcctgtcactacttttgaaggaacttggcaaattccaataacttggactagtcaaggaaatgtggacttttatgatcttaagccatcccgtattttaactggaacttctacaactatcgatgttggcactgatcaaagaggttggcttattttcaacaaacagcaaactggtttctacagggttgactacgatccaattacttgggcacataacaccatggctctaaggaacgctgaagtaaggaaggacatccatgtatacaaccgtgcccagatcgtggatgacgtatttttactagccagatctgaaaggatgacctacagacaggcgtttaacattctctcgttccttgaatttgaagacgagtacgcaccttggatcgccgctattgccggatttaactttgctgtgaggagattggctcacgatgaagctgctttagccaagttacaggcacatatccacagcactgccgctgctgttgtcaatcgtttaggttacgaagacaagggtggagacgataactttatggacgacctcctccgcatgaacctcatgcagttcctctgcaacgtcaatcacgaaaagtgtatagaggaaggagtcaaatccttccagagctggaaagcgaatgaagcattccacatccccgctaaccaccgtccatgggtctactgcgctggtctccgggctggtgacgctagcgatttcgatgtcttctggtcacgttacctcaaagaagatctggctagtgagaaggtagtcatggttactgcagccggttgtactggagacgaggcaagcttacgcaagttcctgaatgccattgtggatgacaaggaagacattagacctcaagactattctgttgccctcaactctgccattgcttcaaacgaagttaatacactgagagccttcgaatggttgaaaactaacgtggaccaaactgtgaagacgcttggcagtatcaactctcctctcagcacaattagcagtcgactgttgaatgacgctcagattaatactgtcgaaacctggttgaatgaaaacgctgaaattatcggtgcatcagctgtagccgctggcagatctggtattgcgacttctaagagcaatatcgagtggttgactaagaggaaggttgaattcgaagattacttcgaaaccgggttcgaagatcccttggccccaccagtaaccgaaactgaagcctcgaccagcagcccgacagctgctccgtccaccaccgaggctcctgcctcagcaagcactgccgcacttagtgtcgtcgccatgttggtcacccttgctgtcaacatggtctaa

SEQ ID NO: 94 - DNA, 2880 bp, Trichoplusia ni
atgtcccaaacattgctatgggccctgggcttagcgctcctggcggttgccaaggccgacaaccctatatcttattatatagaatcccaggatttcccatttgatgaaataccagaagatacgatctccagaaatgatcaacgagtgtacagactcccaacgtctgtggttcccgtagaatatgatattcatataaatctattctttgctgagaggactgaaaaaccattcagctatgaaggatttgagaccatcattgttgaggcaaaggaagaagtcaatgaaatcgtccttcatgctaatgtggacagaattcagtcaatctcggtgtttgactccacgggcagacctctcagactacagcgatttaatccattccatacggagaaagtctaccactttctgaagatcaatctcgctgagactttggcagttggcgcgaaatacactcttcacattaattatgaaggtaccatgaacgtagggcctatgaagcgaggtatttggaggggatggtacgtcgacagtaacaatgttgaaaggatttacgccaccactcacttccagccttataatgccaggcaggcattcccatgctgggatgagccttatttcaaggcaattttcaaactacaccttagtagtccatcaggatatactggaacattctcaaacactgccatcgaacaaacagtttctttacccaacaaccgagtaagagtggactttgcgcctacacccaaaatgtcttcttacctcgtcactttcttagtcagcgagagcttccaagtcattgctcaggacacctccttcgatcctccgatcaggatcatcggcagatctaacacgaacggtctcgcagaccacgccttggacctggctgttaaaatgaccaagtactttgattcttacttcgaaatcccttattcatctctaagccctaatttattgaatgatcacatctcatctcctgattgggcttcagctggtactgaaaactggggaatggtcagttacagagagctctacctgatcttaagtgaagaagagacacttatgtctgttgagcactacgctgctactctggtatcccacgagctcgcacacaaatggttcggcaacttgatcacttgccactggtggagtaacacctggatcaacgaaggatatgccagctacttcggatacattgcaactcatgagatgttccctaaatacgagtttcctgaccacttcaacacccgatacctccagacttctctgtccttcgactctggtgtcagcactgttcctttgaaccacgacgtcaacactcctgctcaggtcaccggtcacttcggaactatcagttactcgaaagccgcagcctttttgagaatgactgctaatattatgtccccagagacctttaggaagtcttgcaaattgttcttgcaaagcaatgcctactcacctactgatccagatgatctattgaaatctatgctcgaagccattgaagaagacaactctttagctgactacggaagcttcagctttgctgactactacaacatctgggttaacgagcccggatacccaattctaaatgttactgttaaccacactaccggagtgatctccttgtctcaggaacgatttttcctaagttcgtctgctgcacctactggtcaaatctatccaattcctattactttctcaacaaaaacaaaccccagcttttcaatcctgaagccttctcatataatgacgggagcgactctcaccataaacaaagcggctgtcgaagaatgggtgatatttaataatatgcagcacggtcactacagagttaactatgattcgaaaacctggtctctgattgcggaagctttgttagaggaaccctcaccaatccatattttgaacagggctcagatcgtggacgatgtctttgccctaatgagatcgaacaggatgacacacaatgacggcttcaaaattttgaagttcttagccaaggagaccagtatacacatttggagccctgctattagtgggtttacctggctaaggaataggctgcgacacctaccggcaaaacaagctgaatttgatgcatttcttctcagtcaaatggaacatgcaatcaacgaattaggttatgagccaaagcccaatgagacgcctacaattacgatggctcgtcaagacatcctacagttcgcttgcactctcggccatgaaaagtgcaaccaggattcttgggagagattcgttaacctgcgagataacggggttccgatcaacgctcgtatccgtcgtaacgtctacatgacagctatgaggaaaggaaaccaacgcgacttcgagtatttactgaaccgcttcagatcgtccaactatgctaacgaccaactggaaatgttgcgaggaatgggcgcttctactgaccctgagttattgaccagatatttggcattgacgttacaaaaagccgttaggacgcatgacaagctgaactcctttaactacgcccttcttggaaacaacgagaacgttaaaactgtcgtcatgttcgtcaagcacaacattgatcaaattagaacagcatacgttgaagattctccagcaaacccagtccatagcgccctatccaatatcgccgcgtacttagatgaggatggtctggacgattatgaacattggctccgtacaacacagtctggtataccgcagtttaattcagcaatttctggtatcaactctgctcgcaacaacatagcttggggcacagcgaacgctgacgtcatccttgctgctgcaagaggcagcgctgccgctgcagtagcttcaataacgctactgatctgtatggctctcctgtcgacttttgtttaa

SEQ ID NO: 95 - DNA, 5202 bp, Trichoplusia ni
atggaggctgacgtccgaatcacgacggcagcgctgttattattcgctgccagctttgtcaacgcacaaaatgatggattgcgatgtacgtacatgaaagaaatacccagaggagaaactcccgtttttgaaataaaggactttgatggagtaccatggaaccagcagcctcttataccactgccacagcgagaggaactgtgcatagaagatcctgcctttgcaggaaattccatcgtcatgacaatttttatggaggaagagatcgagggagaaatagctatagccaagttaaattataaaggcactgaaaccccgagcatcaggcaacccttcgcttcaggtagtttccacatgctcggtcctgtcattcgtcggattcctgaagatggcggcgactggcaccttgttatcactaataagcaggactacgaggctcccgacatgcagcgctactcgttcgacatctcggtgccgagtgaatcagccgtcctcatagtgatgctggacatcatcaacatcgacgacaacgctcccataatacacatgatcgaccgttgcgagatacccgagccgggcgagttaggccgcacgtcgtgtgtgtacacggtgacggacgcggacggtcgcctcagcacggagttcatgacgtatgagatcgagagcgaccgcgacgacgctgactacttcgagctggtcaacgaccacaccatcgaccctgacgacaagaccactcacatggtcctctacctacacaaagccctagacttcgagctcaatcctcttcatatattcagagtcacggctttggactcgaagcccaacacccacactgtgacaatgatggtgcaagtcctgaacgtggaccgtaggaacccgcgctggctggacatcttcgccgtgcagcagttcgatgagaagactgtgcagaggttccacatcagggccatagatggtgacacggggctcgacagagaaatctactataagctggaagcggacgaagaagatacattcttctccctggagccaatcgcgggagatcgcagcggcgccacattagttgttgacaagatagacagagacactctacagcgggaagtgttccagctgtccatagtagcgtataagtacggtatcgatgataaagaggggaagaaccccttcgagaccagagccaacatcgtgatcatcgtcaatgacgtcaacgatcaaaggcctctccctttcaagaatacctacacaatagaaatagacgaagagacgcccatgaccctcaatttagaagactttgggttccacgacatagatctcggtgaaaacgctcaatatgaagtgttcttggagagtgtataccctgaaggtgccgaggaagctttcatgatctccccgacgaggggataccaggaacaatcgttcatagtgtcgacgagaaaccaccaccttctggactatgaagtggaaaaatatcaaaacattcagctaaaggtaaaagcaatagacttgaacgatactcgtttaacgggtgaggcgttgttgaacattaacctccggaactggaacgacgagctcccgatcttcgagcacagcgcgcagacggtagactttgacgagaccgtcgggaaggacttccctgtggccatcgtcaaggctgacgacagagatatcggtgataaagtcgtacactcattactaggcaatgctgaagattatctgacaattgatccggacactggtgagatatccgtcgctcacgatgactacttcgacttccatcggcaaaatgagttctttgttcaggtccgcgccacggacacgctgatggagccctacaactcggtgaccgcgcagctcaccatcaggctgcggaacatcaacaacacgccgcccacgctgctactccctcgcggtagtcctgaagtggaagagaacgtgccgcaagacttcgtgataccggcagagatcgcggccacggaccccgacctcgacgcacaactcgagttcgaaatagactgggagagctcgtacgcgaccaagcagggaagaccagctcccgatgttgagttccataaatgcgtggaaataataaccatccccacggagacccgtcaccgcgtcatcgggcgcctggacgtgaggaccatcagagagggagtcaccatcgactacgaggagttcgagatcctgtacctcagcatcaaggtctatgacaggaacactgtggctggtgctatcgatcatgctgaatcgatcctggccattaacataatcgacatgaacgacaacccgccggtgtgggcggcgggacagctgcggcaggcgctgcgcgtgcgcgagggctcgcccgccggcgggatcatcggctcactgctcgccaccgacatcgacggcccgctctacaataaagtgcggtactccatacatcctaagccaggcaccaaagaaggcctagtagcgatcgatcccatattgggtcagctgacggtcctgggtgacggagagatagacgcagacgtgcccaagacctggaccctggagtacaccgtcatcgccagcgaccgctgtgtggaggacgacggcgtggcctgcaccggcacggaccccactgtctggaacaccgagggcgatttatctatcgacatcatagacacaaacaacaagaacccggagaccgcgagccccagcattaccgtgtgggtttgggagaacgcgacccatggggaccccgtagcacagctctccgccaccgaccttgacagagacgagttataccacacggtccgctaccagatcctgtactcggtgaacccgatgctgctggagctgttcgcggtgaaccaggactcgggcctcatcaccgtgcactacactaccgacacggtgctggacagagacggcgactatccggaacacaccatcttcctcaacctcttcgataacttctttttcgatggagacgggcaacgcaatatggcggagaagagagtgctcgtggttctgttagatgtgaacgacaacgcgcccgaactgccgctacctgaagaactgtcctggtctgtgtccgaagacgagagagaagaagtacgcgtactaccacatatctacgctccggacagagacgagccggacacggataactctagggtcggctacgcgattcttggccttaaagtgaccaacagagagatcgaagtcccggagctgttcaacatgattcagatagagaacaagacaggagagctcgagaccgctcgccatctgaaaggattctggggaacttatagtatacatatacaggcgtacgaccacggcatccctcagcagatatctgaggagacgtacaccctcaccatccgcccctacaactaccacgaaccggtgttcgtgttcccacaggctggcaacaccttccgcttgtccagggagcagtcgacagtgaacggcgtgttggtccgcgtggacgggcagagcttcccgcgcgtgtcggccaccgacggggacgggctgcacgccggcagcgtcagcttcagcgtcgtcggggctgccgctgaatacttctccatgcgtaacttcgaggacaacactggcgagctttacctgtcgcagcccttgcctctagaagacgatggatttgatatcaccatccgcggttctgacgcgggcacagagccgggctcgctgttctcggaggtgtccttcagactggtgttcgtgcccacgcacggggaccctgtcttcagcgtcagccagtatactgtcgcttttatagaaaaagaggctggtttactggaatcccatcaactgccgagagctgtggacccgaagaactacatgtgtgaggaaatgaacgagccttgtcatgagatatactacagtattatcgataacaacgaggagggttacttccaagtgggctcgaccacaaacgtgatctccctatcccgcgagttggagcgtgcctcgcaggccagtcacgtggtccgcgtggcggcctccaacactctgctggacccggccgcgccgccgccgctgctgccctcctccaccttcctgctcaccatcaatgtccgtgaggctgacccgcggccagtattcgagagagagatctacaccgccggcatctacgagacggatacatccaacagggaactactcactgttcatgcgacacataccgaaggcctagacataacgtacacgatggacctggacacgatggtggtggacccctcgctggagggcgtgagggagtccgccttcacgctgcacccgagcagcggcgtcctgtccctcaacatgaacccgctcgacaccatggtcggcatgttcgaattcgatgtcgtggccactgacaccagaggtgcagaagcccgtactgacgtgaagatctatctgatcacccatctcaacagagtctacttcttgttcaacaacacgctggatgtcgttgactccaacagagctttcatagcggacacgttctcgtcggtgttcagcctgacgtgcaacatcgacgcggtgctgcgcgcgccggacagcagcggcgccgcgcgcgacgaccgcaccgaggtgcgcgcgcacttcatacgggaccacgtgcccgccaccaccgaggaaatagagcagctccgtagtaacacaatactgctgagagcgattcaggaaaccctgttaactcgcgaactgcatctggaggactttgtgggtggctccagcccagagctgggcgtggacaacagcctcacgatatacgtgctgggcgcgctcgccgcgctgctgggcttcctgtgcgtgctgctactcatcaccttcatcgtcaggactagagcgctcaaccgtcgtctggaagccctatccatgactaaatacggctcagtggactccgggctgaaccgcgtgggtctggccgcgcccgggaccaacaagcacgccgtcgagggctccaaccccatctggaacgagaccatcaaagcgccggacttcgatgcgatcagcgacgtttctaacgactcggacctgatcggtatcgaggacctgccgcagttccgcaacgactacttccctcccgctgacgacagctccctgaggggcatcgtacttgataatcagaacaacgacacggtggcgactcacggcaacaacttcaagttcaacgctagccccttcagcccggagttcgggaacacgcccatccggagataa

SEQ ID NO: 96 - DNA, 5202 bp, Trichoplusia ni
atggaggctgacgtccgaatcacgacggcagcgctgttattattcgctgccagctttgtcaacgcacaaaatgatggattgcgatgtacgtacatgaaagaaatacccagaggagaaactcccgtttttgaaataaaggactttgatggagtaccatggaaccagcagcctcttataccactgccacagcgagaggaactgtgcatagaagatcctgcctttgcaggaaattccatcgtcatgacaatttttatggaggaagagatcgagggagaaatagctatagccaagttaaattataaaggcactgaaaccccgagcatcaggcaacccttcgcatcgggtagtttccacatgctcggtcctgtcattcgtcggattcctgaagatggcggcgactggcaccttgttatcactaataagcaggactacgaggctcccgacatgcagcgctactcgttcgacatctcggtgccgagtgaatcagccgtcctcatagtgatgctggacatcatcaacatcgacgacaacgctcccataatacacatgatcgaccgttgcgagatacccgagccgggcgagttaggccgcacgtcgtgtgtgtacacggtgacggacgcggacggtcgcctcagcacggagttcatgacgtatgagatcgagagcgaccgcgacgatgcggtctacttcgagctggtcaacgaccacacgctcgaccctgacgacaaaaccacccacatggtcctctacctacacaaagccctagacttcgagctcaatcctcttcatatattcagagtcacggctttggactcaaagcccaacacccacactgtgacaatgatggtgcaagtcctgaacgtggaccgtaggaacccgcgctggctggacatcttcgccgtgcagcagttcgatgagaagactgtgcagaggttccacatcagggccatagacggtgacacggggctcgacagagaaatctactataagctggaagcggacgaagaagatacattcttctccctggaaccaatcgcgggagatcgcagcggcgccacattagttgttgacaagatagacagagacactctacagcgggaagtgttccagctgtccatagtagcgtataagtacggtatcgatgataaagaggggaagaaccccttcgagaccagagccaacatcgtgatcatcgtcaatgacgtcaacgatcaaaggcctctccctttcaagaatacctacacaatagaaatagacgaagagacgcccatgaccctcaatttagaagactttgggttccacgacatagatctcggtgaaaacgctcaatatgaagtgttcttggagagtgtataccctgaaggtgccgaggaagctttcatgatctccccgacgaggggataccaggaacaatcgttcatagtgtcgacgagaaaccaccaccttctggattatgaagtggaaaaatatcaaaacattcagctaaaggtaagagcaatagacttgaacgacactcgtttaacgggcgaggcgttgttgaacattaacctccggaactggaacgacgagctcccgatcttcgagcacagcgcgcagacggtagactttgacgagactgtcggaaaggacttccctgtggccatcgtcaaggctgacgacagagatatcggtgataaagttgtacactcattgctaggcaatgctgaagattatctgaaaattgatccggacactggtgagatatctgtcgctcacgatgactacttcgacttccatcggcaaaatgagttctttgtccaggtccgcgccacggacacgctgatggagccctacaactcggtgaccgcgcagctcaccatcaggctgcggaacatcaacaacacgccgcccacgctgctactccctcgcggtagtcctgaagtggaagagaacgtgccgcaagacttcgtgataccggcggagatcgcggccacggaccccgacctcgacgcacaactcgagttcgaaatagattgggagagctcgtacgcgaccaagcagggaagaccagctcccgatgttgagttccataaatgcgtggaaataataaccatccccacggagacccgtcaccgcgtcatcgggcgcctcgacgtgaggaccatcagagagggagtcaccatcgactacgaggagttcgagatcctgtacctcagcatcaaggtctatgacaggaacactgtggctggtgctatcgatcatgctgaatcgatcctggccatcaacataatcgacatgaacgacaacccgccggtgtgggcggcgggacagctgcggcaggcgctgcgcgtgcgcgagggctcgcccgccggcgggatcatcggctcactgctcgccaccgacatcgacggcccgctctacaataaagtgcggtactccatacatcctaagccaggcaccaaagaaggcctagtagcgatcgatcccatattgggtcagctgacggtcctgggtgacggagagatagacgcagacgtgcccaagacctggaccctggagtacaccgtcatcgccagcgaccgctgtgtggaggacgacggcgtggcctgcaccggcacggaccccactgtctggaacaccgaaggcgatttatctatcgacatcatagacacaaacaacaagaacccggagaccgcgagccccagcattaccgtgtgggtttgggagaacgcgacccatggggaccccgtagcacagctctccgccaccgaccttgacagagacgagttataccacacggtccgctaccagatcctgtactcggtgaacccgatgctgctggagcttttcgcggtggaccaggactcgggcctcatcaccgtgcactacactaccgacacggtgctggacagagacggcgactatccggaacacaccatcttcctcaacctcttcgataacttctttttcgatggagacgggcaacgcaatatggcggagaagagagtgctcgtggttctgttagatgtgaacgacaacgctcccgaactgccgctgcctgaagaactatcctggtctgtgtccgaagacgagagagaagaagtacgcgtactaccacatatctacgctccggacagagacgagccggacacggataactctagggtcggctacgcgattcttggccttaaagtgaccaacagagagatcgaagtcccggagctgttcaacatgattcagatagagaacaagacaggagagctcgagaccgctcgccatctgaaaggattctggggaacttatagtatacatatacaggcgtacgaccacggcatccctcagcagatatctgaggagacgtacaccctcaccatccgcccctacaactaccacgaaccggtgttcgtgttcccacaggctggcaacaccttccgcttgtccagggagcagtcgacagtgaacggcgtgttggtccgcgtggacgggcagagcttcccgcgcgtgtcggccaccgacggggacgggctgcacgccggcagcgtcagcttcagcgtcgtcggggctgccgctgaatacttctccatgcgtaacttcgaggacaacactggcgagctttacctgtcgcagcccttgcctctagaagacgatggatttgatatcaccatccgcggttctgacgcgggcacagagccgggctcgctgttctcggaggtgtccttcagactggtgttcgtgcccacgcacggggaccctgtcttcagcgtcagccagtatactgtcgcttttatagaaaaagaggctggtttactggaatcccatcaactgccgagagctgtggacccgaagaactacatgtgtgaggaaatgaacgagccttgtcatgagatatactacagtattatcgataacaacgaggagggttacttccaagtgggctcgaccacaaacgtgatctccctatcccgcgagttggagcgtgcctcgcaggccagtcacgtggtccgcgtggcggcctccaacactctgctggacccggccgcgccgccgccgctgctgccctcctccaccttcctgctcaccatcaatgtccgtgaggctgacccgcggccagtattcgagagagagatctacaccgccggcatctacgagacggatacatccaacagggaactactcactgttcatgcgacacataccgaaggcctagacataacgtacacgatggacctggacacgatggtggtggacccctcgctggagggcgtgagggagtccgccttcacgctgcacccgagcagcggcgtcctgtccctcaacatgaacccgctcgacaccatggtcggcatgttcgaattcgatgtcgtggccactgacaccagaggtgcagaagcccgtactgacgtgaagatctatctgatcacccatctcaacagagtctacttcttgttcaacaacacgctggatgtcgttgactccaacagagctttcatagcggacacgttctcgtcggtgttcagcctgacgtgcaacatcgacgcggtgctgcgcgcgccggacagcagcggcgccgcgcgcgacgaccgcaccgaggtgcgcgcgcacttcatacgggaccacgtgcccgccaccaccgaggaaatagagcagctccgtagtaacacaatactgctgagagcgattcaggaaaccctgttaactcgcgaactgcatctggaggactttgtgggtggctccagcccagagctgggcgtggacaacagcctcacgatatacgtgctgggcgcgctcgccgcgctgctgggcttcctgtgcgtgctgctactcatcaccttcatcgtcaggactagagcgctcaaccgtcgtctggaagccctatccatgactaaatacggctcagtggactccgggctgaaccgcgtgggtctggccgcgcccgggaccaacaagcacgccgtcgagggctccaaccccatctggaacgagaccatcaaagcgccggacttcgatgcgatcagcgacgtttctaacgactcggacctgatcggtatcgaggacctgccgcagttccgcaacgactacttccctcccgctgacgacagctccctgaggggcatcgtacttgataatcagaacaacgacacggtggcgactcacggcaacaacttcaagttcaacgctagccccttcagcccggagttcgggaacacgcccatccggagataa

SEQ ID NO: 97 - DNA, 1350 bp, Trichoplusia ni
gctggcaacaccttccgtttgtcccgtgagcaatcgacagtgaacggcgtgttggtccgcgtggacgggcagagcttcccgcgcgtgtcggccaccgacgaggacgggctgcacgccggcagcgtcagcttcagcgtcgtcggggctgccgctgaatacttctccatgcgtaacttcgaggacaacactggcgagctttacctgtcgcagcccttgcctctggaagacgatggatttgatatcaccatccgcggttctgacgcgggcacagagccgggctcgctgttctcggaggtgagcttccgtctggtgttcgtgcccacgcacggggaccctgtcttcagcgtcagccagtatactgtcgcttttatcgagaaagaggctggtttactggaatcccatcaactgccgagagctgtggacccgaagaactacatgtgtgaggaaatgaacgagccttgtcatgagatatactacagtattatcgataacaacgaggagggttacttccaagtggactcgaccacaaacgtgatctccctatcccgcgagctggagcgggcctcgcaggccagtcacgtggtccgcgtggcggcttccaacactctgctggatccggctgcgccacctccgctgcttccatccagcactttcctgctcaccatcaatgtccgtgaggctgacccgcggccagtattcgagcgtgagatctacaccgccggcatctacgagacggatacatccaacagggaactactcactgttcatgcgacacataccgaaggcctagacataacgtacacgatggacctggacacgatggtggtggacccctcgctggagggcgtgcgtgagtccgccttcacgctgcacccgagcagcggcgtcctgtccctcaacttcaacccgagcgccactatggtcggcatgttcgagttcgatgtcgtggctacagacacccgtggtgcagaagcccgtactgacgtgaagatctatctgatcactcatctcaacagagtctacttcttgttcaacaacacgctggatgtcgttgactccaaccgtgctttcatcgcggacacgttctcgtcggtgttcagcctgacgtgcaacatcgacgcggtgctgcgcgcgccggacagcagcggcgccgcgcgcgacgaccgcaccgaggtgcgcgcgcacttcatacggaaccacgtgcccgccaccaccgacgagatcgagcagctccgtagtaacacaatactgctgcgtgcgattcaggaaaccctgttaactcgcgagctgcatctggaggactttgtgggtggctccagcccagagctgggcgtggacaacagcctcaca

SEQ ID NO: 98 - DNA, 2949 bp, Pseudoplusia includens
atggcgaatcgctttaccttcctcctcttgggggtggccctggcccagggtatcctggcttacagccccatcgacctgccagaggacgaatggctagaatataggaatctgatgagggattctaactaccggctcccgagaacaactgaacctgaaacctacaaagttactctaacgccatatttagaggcatctgatggagtcaaacaattcactttcgatggtcaggttgagatactcattgttgccaaggaagctgtttcggaaatccttctacattgcaatgatttgcaaatttcggtactaactgtctcggcacagtctgccgacgcgaatttggtcgaacccggtcaaaccttcaactgcgaagacaatacaagctttttgagaatcaaaaccgcttcgcctttggtggctaattccaaatacgtgataaagagcacatttacgggtaacctccaaactaacatgagaggtttttacaggagttggtactacgacaacagtaacactaagaaatggatggccacaactcaattccaacctggtcacgcccgtcaggctttcccctgctacgatgaaccttctttcaaagcccgttttgatattacaattataaggccaacaaccttctcagacactctatcgaacatgccgatcaaggaaaaggggaccgaagtaaacggcagaattcctgagactttccacactacaccgaagacttctacatatttgcttgcgttcattgtgtcccactatgttcccgtttctactggcaccacccctaacagacccttcgtaatttatgctcgcaacaacgctggcactactggtgattggtccttggatgttggtgaacgtctcctcgacgagatggagaaatacacaggaatagaatactacaaaatggctgattacatgaacatgaaacaggctgccatccctgacttctctgctggtgccatggaaaactggggccttttgacatacagagaagcccttatcttgtacgaccccagacactccaaccatttctacagacagcgtgtagccaacatcgtgtctcacgaagttgctcacatgtggttcggaaacctggtcacttgcgcctggtgggacaatctctggctgaatgaaggattcgcgagattctaccaatattacttgacacacagggttgaaccaaaattaggttacgacacccgtttcatcgtcgagcagcttcacacctccttgctctccgactctagtgccaacgcacatcccctgacagacgaaagcgtcagcagtccgactaccgtcagcgcgcacttctcaaccatcacctacgccaaaggagcctccgtcctgagaatgacgcagtacttgcttggtgtcgaaacctacgaaaaaggtcttagaaagtatcttgaagaccacaaatatgatgtcgcaacacctgatgatttgttcaatgctctgcaaaacgctgcaacagatgacgcagctttgagccaatacgccggtgctactgtcaaggaatattttgaaagttggacacagaagcccggtcaccccctactgacagtcgccgttaataacgatggaacgatgcaaataactcaggaacgctttggcctcactccatctacagcaacgcaaggcctttggcacattcccatatcttggactagacaaggcgaagttgactttgacaatcttaaaccatcacagattttaactgcaactagtatacaagtagatgtaggcactactgaaagaggttggcttattttcaacaaacagcaaactggtttctacagagtgaactacgaccctactacttgggcacacaacactatggctcttaggaatagtgaggaaagggccaaaattcatgaattcaaccgtgcccagatcgtggatgacgtattcttgctagccagatctgaaaggatgaactacagagttgcgttcaacattctctcgttccttgaattcgaagatgcgtacgcaccttggatcgctgctattgccggattcaactttgctttgaggagatttgctcatgatgaagttgcattagcgaagttacagtcacacattcacaccgctgccacggctgttgtcaaccgcctgggcttcgaagacaagggtggagacgataattacatggacgatctcctgcgcatgtacgtcatgcagttcctctgcaatgctaaacacgaaaaatgtgttgaagaaggagtaaaattattccagagctggaaagcggacccacaattccacatccccgcaaaccatcgtccatgggtctactgcgctggtctccgagctggcgacgcttctgatttcgatgtattctgggcacgttacctcgctgaaaccctggctagtgagaaagtggtcatggttactgcagccggttgtactggtaacgaagctagcttacgcaagttcttggattccattgtcgatgacgaggaagacattagacctcaggactactctgttgccctaaactcagccataactggaaacgaagttaacactttgagagccttcgaatggttgaaggataacattggccaaacagcgaaaacgcttggcagtatcaactctcctctctctaccatcagcagtcgactgttgaatgaggaacagattaatacagtcgatacctggctgaccgcacaagctactgtaatcggcacatcagctgtcaacgctggcagggctggtattgagacttctaggaacaacatcgagtggctgaataagaggaagagcgagttcgaggagtacttcgaaagcgggttcgatgatcctttggtcaccccgcctgctgagacgacgacgcccgcatcgacctctgcgccaaccaccacggaagcccccgcctccgcgcacactgccgctcttagcgtcgtcaccctgttggtcacccttgcagtcaacatgatcaactaa

SEQ ID NO: 99 - DNA, 5322 bp, Pseudoplusia includens
atggaagtcgacgtgcggatcacgacggcagcgctgctaatattcgctgccacccttgtcagcgcacagactaatcaattacgatgcacttatattcaggaaatacctaggggagatacaccagttttcaactttcccagttttgatggagtgccatggtcacagcagcctttgttaccactcccgcagcgggaggagctctgcatggaagacccagtctctgcggggagctccgtcatcatgaccatttacatggaggaggaaatcgaggaagaaatagccattgctaagttaaattataaaggcactggaactccggaaatcgggccagccttcacgacaggtagtttccacacgctcggtcccgtctttcgtcggatccctgaagatggcgaatggcatcttgttatcactaacaagcaggactttgaggctcctaatatgcagcgctactcgttcgatatctcggtgccgggcgagtccgtcggcctcatggtgctgctggagatcgtcaacatcgacgacaacgctcccatcgtacacatgatcgaccgctgcgagatacccgagccgggtacacacgggcgtacggcctgtgcttacactgtgtcggacgcggacgggcgcatcagcacggagttcatgacgtacaagatcgatagcgaccgcaacgaccaggacttcttcgagttggtcaacgaccacaccatggacgcagacgaaaagatcacccacatggtcctctacctacataaagacctggacttcgaagttaaccctcttcatatattctccgtcacagcttttgactcgaagccgaacgagcacgaggtgaccatgatggtgcaagtccagaacacggaccgtcgcaacccgcgctggctggacatcttcgccgtgcagcagttcaacgagaagaccacgcagaggttccccatccgcgccatcgacggcgacacggggatcgatcgacaaatacactacaggctcgaagcagacgaagaagacaccttcttttcgctggagctagcagcggatggtaacggcgcagtgcttgtcgtcgacgagatagacagagacactctcatgagggaagtgttccagctctccatagtagcgtacaagtacggccccaatgatgaagaggacaggccatccttcgagaccagagccaacatcgtcatcatcgtcatcgacgtcaatgatcaacgtcctattcccttcaaacaaattgatgatgataataataatgatgatggtgatgacagtagtgatgatgatgaagacagctcagctgattccagccgcaatgagcttgctcctgaggttcctgaagaccccacaattcgcatctataagatcacaatagaggaagagacgcctatgacgctcaatttacaagatttcggtttccacgacagagatctcggtgagaacgcacaatacgaagtgcacttggagagtatctcgccggaaggtgcggaggaagctttctctatctcgccaaccagggggtaccaggaccagtcgttcattgtctccaccaggaaccacagacttctggacttcgaagtggaagagttccagaagatccggctgagggtgatagcaatagacttgaacgacactagcttgaggggcgaggcgtggctgcacatagacctggagaactggaacgatgagatgcccatcttcgggcaagatgtgtatacggcggagttcgacgagactgtcggcgaagggttccctgtggctaccgtcagagctactgacagagacatcggcgatagagttgtgcattcactgctgggcaatgctggagactacctgactattgaccctgacaccggggagatattcgtcgctcacgataactacttcgacttccatcggcagaacgagtactttgttcaggtgcgtgcgacggacacactgctggatacgaacaacacagccacggcgcagctcaccatcaaactgcgcaacatcaacaacacgccgcccacgctgctgctccctcgtttcagtcctgaagtgaaagagaacgtgccggaagacttcgtgatcccggcggacatcgaggccacggaccccgacctcgacgcgcagctggagttcgagatagactgggaacagtcctacgccaccaagcagggcaggccgacacctgctattgagttccataattgcttggaaatcataacggtccccactgagtcccgtcaccgcgttgtagggcggctcgacgtgcgggagatcaggacaggcgtcaccattgactacgaggagttcgagatcctgtacctcagcatcagggtcatcgacaggaacactgtacctggcgctattgattacgctgaatccatcctcgcgatcaacataatcgacatgaatgacaactggccgatctgggcggcggggcagctgcagcagtcgctgcgcgtgcgcgagggctcggccgctggtgtcgtcatcggctcactactagccacggacatcgacggcccgctctacaacaaagtgcgatactcgctcgtgccgataggagagactaagccggacctagtgacaatagaccctatcttcggtcagctgacagtcctgaccggagggcagatcgacgcggacgagcccaagacgtgggccctggagtacaccgtgacggccagcgaccgctgcgtagaggacgacggcttcccttgcactggggacgaccccactgtatggaacactgagggatatttgtgtatcgacataatagacacgaacaacaaaagcccagagacggagaacgcgaacatcacggtgtgggtgtgggagaacgccacggagggagacactgtcgcgcagctctccgccacagacctcgacagggacgagctgtaccacacggtccgctaccagatcctgtactcggtgaacctccgcctgctgaacttcttcgcggtggacctggacaccggcctcatcacagtgcactaccccaccaacgaggtgctggacagagacggcgacgagcccgaacacaccatcttcctcaacttgtttgataacttctattttgatggagacggacagcgcaacatggcggagaagacagtgcgcgtgcgcttactggacgtgaacgacaacgcgccggaactgccgccgcctgacgaactctcctggactgtctccgaggacgaacccgctgaaagtcgtgtgctaccagaaatctacgctccggatagagacgagccggacacggataactctcgggtcgggtacgcgatcctcggccttgaggtgaaccgggacatagaagtcccggaactgttcaccatggtacagatagagaacgtcaccggcgagctcgagaccgcgatgcatttgaaaggattctggggcacttatactatacacatacaggcgtacgaccacggcatcccgcagcaggtgtcggaggagaggtactcgctggtggtgcggccctacaactaccacgcgccggagttcgtgttcccacaacaaggcgccgtctacagactgtccttggagcagtcgacagtgaacggcgtactagtacaagtgtccgggcagagcttcccgcgcgtcacagctacggatgaagacggactgcacgcgggggctgtcactttcagcgtcgtcggagctcccggcgaatacttctccatgcgtaacttcgatgataacaccggcgagctgtatctaacgcagcctttagtcaacacggaattagatatcaccatccgcggcacggacggcggcaccgagccggactcgaagttctccgagctgtccttcaggctggtgttcgtcaccacgctgggagaccccaccttcgctgtagaggaacacactgtcgcttttatagaaaaagaggctggtttactggagagcttccagctgccaactgctgtggacgcgaagaactacttgtgtgaggaactgaacgagccttgtcatcagatatactacaattttatcgagggcaacagccagggttacttccaagtggaaccgaccaccaacatgatctcgctaacacgtgagctggaccgcgcggtggaagcccggtatgtgctgcgcgtcggcaccagcaacgcgcccatcgacccctccgcaccgcccacactcatggctgcctccacactactgctcaccgtcaacgtgcgcgaggcggacccgcggccgctgttccagcgcgacatctactctgccggcatctacgagactgacgtcaccgggaagttactgctcactgttcatgcgactcacaccgaagggttagacataacgtacagcatggatatggagacgatggaggtggacctgtcgctggaggccgtgaaggactccgccctcatcctgcatcccactgagggcagtctgaccctcaacatgaacccgctggagaacatggtcggcatgttcgaattcgatgtggtagctactgatactgcgggtgctacagcccgtactgacgtgaagatctatctgatcacgcacctcaaccgcgtcttcttcacgttcaacaacacgctggatgtcgtcgacgccaacagagagttcatcgcggacacgttctctttgggcttcagcctgccgggcttccgcctgacgtgcaacatcgacgcggtcctgcgcgccaccgacagcaacggcatcgcgcgcgacgaccgcaccgaggtgcgcgcgcacttcatacggaacaacatccccgccaccaccgaggagatcgaagagctccgcagtaacacactgctgataaattcgattcaggagaccctgttcactcggtcgctgagcctagaggacttcgtgggtggtgccagtccagagctggaggcggacaacaacctcacggtgtacgtgctgagcgcgctcaccgccatgctcgggctgctgtgcctgctgctgctcgtcaccttcatcatcaggaccagggctctcaaccgtcgtcttgaagcattatccatgacgaagtatggttcagtggactctggtctgaaccgcgcggggctggcggctcccggtaccaacaaacacgccatcgagggctccaaccccatctggaacgagaccatcaaggccccggacttcgatgccatcagcgacgtgtcgaacgactctgacctgatcggcatcgaggacctgccgcagttccgcagcgactacttccctcccggcgacgaccactcgctccagggcatcgtgctcgacaaccagaacaacgacacggtggcgacgcacggcaacaacttcaagttcaacgcgagccctttcagccccgagttcgggaacacgcccatccggagataa

SEQ ID NO: 100 - DNA, 5322 bp, Pseudoplusia includens
atggaagtcgacgtgcggatcacgacggcagcgctgctaatattcgctgccacccttgtcagcgcacagactaatcaattacgatgcacttatattcaggaaatacctaggggagatacaccagttttcaactttcccagttttgatggagtgccatggtcacagcagcctttgttaccactcccgcagcgggaggagctctgcatggaagacccagtctctgcggggagctccgtcatcatgaccatttacatggaggaggaaatcgaggaagaaatagccattgctaagttaaattataaaggcactggaactccggaaatcgggccagccttcacgacaggtagtttccacacgctcggtcccgtctttcgtcggatccctgaagatggcgaatggcatcttgttatcactaacaagcaggacttcgaagctcctaatatgcagcgctactggttcgatatctcggtgccgggcgagtccgtcggcctcatggtgctgctggagatcgtcaacatcgacgacaacgctcccatcgtacacatgatcgaccgctgcgagatacccgagccgggtacacacgggcgtacggcctgtgcttacactgtgtcggacgcggacgggcgcatcagcacggagttcatgacgtacaagatcgatagcgaccgcaacgaccaggacttcttcgagttggtcaacgaccacaccatggacgcagacgaaaagatcacccacatggtcctctacctacataaagacctggacttcgaagttaaccctcttcatatattctccgtcacagcttttgactcgaagccgaacgagcacgaggtgaccatgatggtgcaagtccagaacacggaccgtcgcaacccgcgctggctggacatcttcgccgtgcagcagttcaacgagaagaccacgcagaggttccccatccgcgccatcgacggcgacacggggatcgatcgacaaatacactacaggctcgaagcagacgaagaagacaccttcttttcgctggagctagcagcggatggtaacggcgcagtgcttgtcgtcgacgagatagacagagacactctcatgagggaagtgttccagctctccatagtagcgtacaagtacggccccaatgatgaagaggacaggccatccttcgagaccagagccaacatcgtcatcatcgtcatcgacgtcaatgatcaacgtcctattcccttcaaacaaattgatgatgataataataatgatgatggtgatgacagtagtgatgatgatgaagacagctcagctgattccagccgcaatgagcttgctcctgaggttcctgaagaccccacaattcgcatctataagatcacaatagaggaagagacgcctatgacgctcaatttacaagatttcggtttccacgacagagatctcggtgagaacgcacaatacgaagtgcacttggagagtatctcgccggaaggtgcggaggaagctttctctatctcgccaaccagggggtaccaggaccagtcgttcattgtctccaccaggaaccacagacttctggacttcgaagtggaagagttccagaagatccggctgagggtgatagcaatagacttgaacgacactagcttgaggggcgaggcgtggctgcacatagacctggagaactggaacgatgagatgcccatcttcgggcaagatgtgtatacggcggagttcgacgagactgtcggcgaagggttccctgtggctaccgtcagagctactgacagagacatcggcgatagagttgtgcattcactgctgggcaatgctggagactacctgactattgaccctgacaccggggagatattcgtcgctcacgataactacttcgacttccatcggcagaacgagtactttgttcaggtgcgtgcgacggacacactgctggatacgaacaacacagccacggcgcagctcaccatcaaactgcgcaacatcaacaacacgccgcccacgctgctgctccctcgtttcagtcctgaagtgaaagagaacgtgccggaagacttcgtgatcccggcggacatcgaggccacggaccccgacctcgacgcgcagctggagttcgagatagactgggaacagtcctacgccaccaagcagggcaggccgacacctgctattgagttccataattgcttggaaatcataacggtccccactgagtcccgtcaccgcgttgtagggcggctcgacgtgcgggagatcaggacaggcgtcaccattgactacgaggagttcgagatcctgtacctcagcatcagggtcatcgacaggaacactgtacctggcgctattgattacgctgaatccatcctcgcgatcaacataatcgacatgaatgacaactggccgatctgggcggcggggcagctgcagcagtcgctgcgcgtgcgcgagggctcggccgctggtgtcgtcatcggctcactactagccacggacatcgacggcccgctctacaacaaagtgcgatactcgctcgtgccgataggagagactaagccggacctagtgacaatagaccctatcttcggtcagctgacagtcctgaccggagggcagatcgacgcggacgagcccaagacgtgggccctggagtacaccgtgacggccagcgaccgctgcgtagaggacgacggcttcccttgcactggggacgaccccactgtatggaacactgagggatatttgtgtatcgacataatagacacgaacaacaaaagcccagagacggagaacgcgaacatcacggtgtgggtgtgggagaacgccacggagggagacactgtcgcgcagctctccgccacagacctcgacagggacgagctgtaccacacggtccgctaccagatcctgtactcggtgaacctccgcctgctgaacttcttcgcggtggacctggacaccggcctcatcacagtgcactaccccaccaacgaggtgctggacagagacggcgacgagcccgaacacaccatcttcctcaacttgtttgataacttctattttgatggagacggacagcgcaacatggcggagaagacagtgcgcgtgcgcttactggacgtgaacgacaacgcgccggaactgccgccgcctgacgaactctcctggactgtctccgaggacgaacccgctgaaagtcgtgtgctaccagaaatctacgctccggatagagacgagccggacacggataactctcgggtcgggtacgcgatcctcggccttgaggtgaaccgggacatagaagtcccggaactgttcaccatggtacagatagagaacgtcaccggcgagctcgagaccgcgatgcatttgaaaggattctggggcacttatactatacacatacaggcgtacgaccacggcatcccgcagcaggtgtcggaggagaggtactcgctggtggtgcggccctacaactaccacgcgccggagttcgtgttcccacaacaaggcgccgtctacagactgtccttggagcagtcgacagtgaacggcgtactagtacaagtgtccgggcagagcttcccgcgcgtcacagctacggatgaagacggactgcacgcgggggctgtcactttcagcgtcgtcggagctcccggcgaatacttctccatgcgtaacttcgatgataacaccggcgagctgtatctaacgcagcctttagtcaacacggaattagatatcaccatccgcggcacggacggcggcaccgagccggactcgaagttctccgagctgtccttcaggctggtgttcgtcaccacgctgggagaccccaccttcgctgtagaggaacacactgtcgcttttatagaaaaagaggctggtttactggagagcttccagctgccaactgctgtggacgcgaagaactacttgtgtgaggaactgaacgagccttgtcatcagatatactacaattttatcgagggcaacagccagggttacttccaagtggaaccgaccaccaacatgatctcgctaacacgtgagctggaccgcgcggtggaagcccggtatgtgctgcgcgtcggcaccagcaacgcgcccatcgacccctccgcaccgcccacactcatggctgcctccacactactgctcaccgtcaacgtgcgcgaggcggacccgcggccgctgttccagcgcgacatctactctgccggcatctacgagactgacgtcaccgggaagttactgctcactgttcatgcgactcacaccgaagggttagacataacgtacagcatggatatggagacgatggaggtggacctgtcgctggaggccgtgaaggactccgccctcatcctgcatcccactgagggcagtctgaccctcaacatgaacccgctggagaacatggtcggcatgttcgaattcgatgtggtagctactgatactgcgggtgctacagcccgtactgacgtgaagatctatctgatcacgcacctcaaccgcgtcttcttcacgttcaacaacacgctggatgtcgtcgacgccaacagagagttcatcgcggacacgttctctttgggcttcagcctgccgggcttccgcctgacgtgcaacatcgacgcggtcctgcgcgccaccgacagcaacggcatcgcgcgcgacgaccgcaccgaggtgcgcgcgcacttcatacggaacaacatccccgccaccaccgaggagatcgaagagctccgcagtaacacactgctgataaattcgattcaggagaccctgttcactcggtcgctgagcctagaggacttcgtgggtggtgccagtccagagctggaggcggacaacaacctcacggtgtacgtgctgagcgcgctcaccgccatgctcgggctgctgtgcctgctgctgctcgtcaccttcatcatcaggaccagggctctcaaccgtcgtcttgaagcattatccatgacgaagtatggttcagtggactctggtctgaaccgcgcggggctggcggctcccggtaccaacaaacacgccatcgagggctccaaccccatctggaacgagaccatcaaggccccggacttcgatgccatcagcgacgtgtcgaacgactctgacctgatcggcatcgaggacctgccgcagttccgcagcgactacttccctcccggcgacgaccactcgctccagggcatcgtgctcgacaaccagaacaacgacacggtggcgacgcacggcaacaacttcaagttcaacgcgagccctttcagccccgagttcgggaacacgcccatccggagataa

SEQ ID NO: 101 - DNA, 5322 bp, Pseudoplusia includens
atggaagtcgacgtgcggatcacgacggcagcgctgctaatattcgctgccacccttgtcagcgcacagactaatcaattacgatgcacttatattcaggaaatacctaggggagatacaccagttttcaactttcccagttttgatggagtgccatggtcacagcagcctttgttaccactcccgcagcgggaggagctctgcatggaagacccagtctctgcggggagctccgtcatcatgaccatttacatggaggaggaaatcgaggaagaaatagccattgctaagttaaattataaaggcactggaactccggaaatcgggccagccttcacgacaggtagtttccacacgctcggtcccgtctttcgtcggatccctgaagatggcgaatggcatcttgttatcactaacaagcaggacttcgaagctcctaatatgcagcgctactggttcgatatctcggtgccgggcgagtccgtcggcctcatggtgctgctggagatcgtcaacatcgacgacaacgctcccatcgtacacatgatcgaccgctgcgagatacccgagccgggtacacacgggcgtacggcctgtgcttacactgtgtcggacgcggacgggcgcatcagcacggagttcatgacgtacaagatcgatagcgaccgcaacgaccaggacttcttcgagttggtcaacgaccacaccatggacgcagacgaaaagatcacccacatggtcctctacctacataaagacctggacttcgaagttaaccctcttcatatattctccgtcacagcttttgactcgaagccgaacgagcacgaggtgaccatgatggtgcaagtccagaacacggaccgtcgcaacccgcgctggctggacatcttcgccgtgcagcagttcaacgagaagaccacgcagaggttccccatccgcgccatcgacggcgacacggggatcgatcgacaaatacactacaggctcgaagcagacgaagaagacaccttcttttcgctggagctagcagcggatggtaacggcgcagtgcttgtcgtcgacgagatagacagagacactctcatgagggaagtgttccagctctccatagtagcgtacaagtacggccccaatgatgaagaggacaggccatccttcgagaccagagccaacatcgtcatcatcgtcatcgacgtcaatgatcaacgtcctattcccttcaaacaaattgatgatgataataataatgatgatggtgatgacagtagtgatgatgatgaagacagctcagctgattccagccgcaatgagcttgctcctgaggttcctgaagaccccacaattcgcatctataagatcacaatagaggaagagacgcctatgacgctcaatttacaagatttcggtttccacgacagagatctcggtgagaacgcacaatacgaagtgcacttggagagtatctcgccggaaggtgcggaggaagctttctctatctcgccaaccagggggtaccaggaccagtcgttcattgtctccaccaggaaccacagacttctggacttcgaagtggaagagttccagaagatccggctgagggtgatagcaatagacttgaacgacactagcttgaggggcgaggcgtggctgcacatagacctggagaactggaacgatgagatgcccatcttcgggcaagatgtgtatacggcggagttcgacgagactgtcggcgaagggttccctgtggctaccgtcagagctactgacagagacatcggcgatagagttgtgcattcactgctgggcaatgctggagactacctgactattgaccctgacaccggggagatattcgtcgctcacgataactacttcgacttccatcggcagaacgagtactttgttcaggtgcgtgcgacggacacactgctggatacgaacaacacagccacggcgcagctcaccatcaaactgcgcaacatcaacaacacgccgcccacgctgctgctccctcgtttcagtcctgaagtgaaagagaacgtgccggaagacttcgtgatcccggcggacatcgaggccacggaccccgacctcgacgcgcagctggagttcgagatagactgggaacagtcctacgccaccaagcagggcaggccgacacctgctattgagttccataattgcttggaaatcataacggtccccactgagtcccgtcaccgcgttgtagggcggctcgacgtgcgggagatcaggacaggcgtcaccattgactacgaggagttcgagatcctgtacctcagcatcagggtcatcgacaggaacactgtacctggcgctattgattacgctgaatccatcctcgcgatcaacataatcgacatgaatgacaactggccgatctgggcggcggggcagctgcagcagtcgctgcgcgtgcgcgagggctcggccgctggtgtcgtcatcggctcactactagccacggacatcgacggcccgctctacaacaaagtgcgatactcgctcgtgccgataggagagactaagccggacctagtgacaatagaccctatcttcggtcagctgacagtcctgaccggagggcagatcgacgcggacgagcccaagacgtgggccctggagtacaccgtgacggccagcgaccgctgcgtagaggacgacggcttcccttgcactggggacgaccccactgtatggaacactgagggatatttgtgtatcgacataatagacacgaacaacaaaagcccagagacggagaacgcgaacatcacggtgtgggtgtgggagaacgccacggagggagacactgtcgcgcagctctccgccacagacctcgacagggacgagctgtaccacacggtccgctaccagatcctgtactcggtgaacctccgcctgctgaacttcttcgcggtggacctggacaccggcctcatcacagtgcactaccccaccaacgaggtgctggacagagacggcgacgagcccgaacacaccatcttcctcaacttgtttgataacttctattttgatggagacggacagcgcaacatggcggagaagacagtgcgcgtgcgcttactggacgtgaacgacaacgcgccggaactgccgccgcctgacgaactctcctggactgtctccgaggacgaacccgctgaaagtcgtgtgctaccagaaatctacgctccggatagagacgagccggacacggataactctcgggtcgggtacgcgatcctcggccttgaggtgaaccgggacatagaagtcccggaactgttcaccatggtacagatagagaacgtcaccggcgagctcgagaccgcgatgcatttgaaaggattctggggcacttatactatacacatacaggcgtacgaccacggcatcccgcagcaggtgtcggaggagaggtactcgctggtggtgcggccctacaactaccacgcgccggagttcgtgttcccacaacaaggcgccgtctacagactgtccttggagcagtcgacagtgaacggcgtactagtacaagtgtccgggcagagcttcccgcgcgtcacagctacggatgaagacggactgcacgcgggggctgtcactttcagcgtcgtcggagctcccggcgaatacttctccatgcgtaacttcgatgataacaccggcgagctgtatctaacgcagcctttagtcaacacggaattagatatcaccatccgcggcacggacggcggcaccgagccggactcgaagttctccgagctgtccttcaggctggtgttcgtcaccacgctgggagaccccaccttcgctgtagaggaacacactgtcgcttttatagaaaaagaggctggtttactggagagcttccagctgccaactgctgtggacgcgaagaactacttgtgtgaggaactgaacgagccttgtcatcagatatactacaattttatcgagggcaacagccagggttacttccaagtggaaccgaccaccaacatgatctcgctaacacgtgagctggaccgcgcggtggaagcccggtatgtgctgcgcgtcggcaccagcaacgcgcccatcgacccctccgcaccgcccacactcatggctgcctccacactactgctcaccgtcaacgtgcgcgaggcggacccgcggccgctgttccagcgcgacatctactctgccggcatctacgagactgacgtcaccgggaagttactgctcactgttcatgcgactcacaccgaagggttagacataacgtacagcatggatatggagacgatggaggtggacctgtcgctggaggccgtgaaggactccgccctcatcctgcatcccactgagggcagtctgaccctcaacttcaacccgacggcgaacatggtcggcatgttcgaattcgatgtggtagctactgatactgcgggtgctacagcccgtactgacgtgaagatctatctgatcacgcacctcaaccgcgtcttcttcacgttcaacaacacgctggatgtcgtcgacgccaacagagagttcatcgcggacacgttctctttgggcttcagcctgccgggcttccgcctgacgtgcaacatcgacgcggtcctgcgcgccaccgacagcaacggcatcgcgcgcgacgaccgcaccgaggtgcgcgcgcacttcatacggaacaacatccccgccaccaccgaggagatcgaagagctccgcagtaacacactgctgataaattcgattcaggagaccctgttcactcggtcgctgagcctagaggacttcgtgggtggtgccagtccagagctggaggcggacaacaacctcacggtgtacgtgctgagcgcgctcaccgccatgctcgggctgctgtgcctgctgctgctcgtcaccttcatcatcaggaccagggctctcaaccgtcgtcttgaagcattatccatgacgaagtatggttcagtggactctggtctgaaccgcgcggggctggcggctcccggtaccaacaaacacgccatcgagggctccaaccccatctggaacgagaccatcaaggccccggacttcgatgccatcagcgacgtgtcgaacgactctgacctgatcggcatcgaggacctgccgcagttccgcagcgactacttccctcccggcgacgaccactcgctccagggcatcgtgctcgacaaccagaacaacgacacggtggcgacgcacggcaacaacttcaagttcaacgcgagccctttcagccccgagttcgggaacacgcccatccggagataa

SEQ ID NO: 102 - DNA, 3045 bp, Helicoverpa zea
atggcgaaccgctggtacaccctccttttgggggccgctcttctgcagagcgtcctctccttcggtcctattgaagtgacagacgacgaatgggctgaatacagaaacctgatgcgggaccctgcttaccgcctgcccacgactacgaagcctagcaactacgccgtcaaccttacaccatacttcactggcaccaccttagctttcacctttgagggctcagtacgcatcaccattacggccacgcaggctaatgtcaacgaaattgtgctccattgcaatgacttgaccatcgaatcggtcatggtggctaccgaagctagcccgaatgttaatcttattgcaagcggacagacttttgtctgcgatcctgtatacagtttcctaagaataaggaccgcatcagccttgaatattaacacgaattatataatcacgagtaacttcagaggcaaccttcaaacgaacatgagaggtttttacaggagttggtatgtcgactctagtggtaccaagagatggatggcaacgacccaattccagcctggccatgctcgccaagccttcccctgctacgacgaaccaggattcaaagccactttcgatattaccatcaacagggaagccgacttcagcccaaccctttccaacatgcccattagaaccacaactcccctcgcaaccggcagagttgctgagacgttccacaccactcccgaaacatctacgtacttgattgcttttatagtatcgcactatagtcaagtagcttcaaacaacaaccagcagaggcctttccatatctatgctagagacaatgttggggtccatggaaacttcgccttggaaattggagtgcctctcttggaagtcatggagcgctatacagaaataccttactatggcatggctcaaaacatgaacatgaagcaagctgctatccctgacttctcagctggtgccatggagaactggggacttttgacttacagggaggctttgattctgttcgatcccgtgaataccaacaacttctacagacagcgtatcgccaacatcatttctcacgaaatcgctcacatgtggtttggaaacctcgtcacatgcgcttggtgggacaacctttggctgaacgaaggttttgcacgattctaccagtactacttgactggcgtggtcgctcctgaaatgggcttcgaaactcgtttcatagtggaacagctgcacgtgtcgatgttgtctgactcccttgactctgctcacgccctcaccaaccccaatgtgaacgaccctactactgtcagcgcacacttctccaccatcacttatgccaaaggcgccagcatcatcagaatgacacaacacttactgggcaacaacacttttgtgaaaggccttaggacttacttgaaagacaatgcctacggtgtcgctgagccccgtcacttgttcactgccttagacgctgctgcaaccgcagacaatgctctcgccaactatggtggtatgaccatcgatcgttacttcagaagctggtcagagaaagctggtcatccattgttgactgtgtccattgaccactcctctggacgtatgaccattattcaaacccgatttgagcgcaatactggtgtatcaacagcgaccgacagtctttgggacatccccattacttggactagggcaggatctattgactttgacaacctgaaacctacgcaattcatcagtggtgttttgactatcatcgacagaggaaccattggcagggaatgggttattttcaataagcagcaaactggtttctatagagttaactacgatcaaatcacttggggtctcatcactcaagctcttaggagtaacgtgaggctatcaatccacgaatataaccgtgctcagatcgtcgatgacgttatgttgttagctcgagctggcattatgacctacagcagagccttgaacattctctccttccttaaatttgaagatcaatatgctccttggggcgcagctattactggattcaacttcgccctccgaagattagctcatgatgttacagctcaccagaaactgaggaatgaaatcttggatttgagcacggccatcgttaatcgtttgggcttcagcgagccagctgttagcaatttcatggacgaccttctccgcatgaacgtcatgactttcctttgtgacatcggccaccaggggtgcatcactgctgctagaactagctttgctacctggaagaacggtggagttgtcccacccaacatgcgtccatgggtgtattgcaatggagtgcgctacggagatcaatctgacttcactcacttgtggaatcgttacacagcatctgacgttgctaacgacaagctggtaatgttgtcggccgctggttgcactcttaaccaggccagcttgaacatattcctcaatgccatcgtgtctggaggcgatgacatcaggcctcaagaccacagcgcagctatcgcagcggctgtccgcagtaatgaagtgaacactatgagagtattcacatggctgcaagctaatgtgcaacagactataaacactctgggaagcgtcagtcctattttgaacgaaatcacagctcgcctattgaatgaagcccaaatcactcaggttcaaacttggttgaatgcaaaccagaacttaattggtactgcagctcacactagcgccacaaatggcatcgccacgtctaggtccaatattcagtggtacacacagagggttcccgaattcaacgtatactttgaaactggatatgttgaagaaaacttcgctgacactacaactaccagtacgactacgactacgacaactactacgaccactacagcagctcctacgactacgacaactacagaggcgcctacgacaacaactacgaccactacgggagcgcctacgaccacaactacagaagctacaacaacacctgtacctggctcagcaaacatcgccactcttagcatcgtcacaatgatcgtgactctcgttgttaatatggcttaa

SEQ ID NO: 103 - DNA, 1608 bp, Helicoverpa zea
atggtgacactgttcccgtacgtagtggcggtgctgtgcggcgcgacgagcgtgcgcgcctactggctgcatcccgcggcgccggccgccgccagccgcgccgagacctctgccaactactgggcgcaagacgcgcaggccgccatcaacgctcgcctggaacgagttgaaagcgtgaagaaagcgcgtaacgtcatcatgttcctgggcgacggcatgtcggtgcccacgctcgccgccgcgcgcacgctgctcggacagcgccaagggaaaacgggagaggagacaaagttgcatttcgagactttccccacaatcggattagtgaagacgtactgtgtggacgcccagattgcagactccgcatgtactgccacagcgtatttgtgtggtgtaaaaaataactatggcgccataggcgtagacggcacggtacgccgaggagactgtcaagccgcttcaaacactgcgacacacgtcgagtccatcgcggagtgggcgctcgctgacggacgagatgtcggtattgtgacgacgactcgtatcactcacgcgtctccggcgggcacgttcgcgaagacggcgaaccgcacctgggagaacgacggtgaagtgtcgcagatgggcttggacgccaaggactgccctgacatcgcgcatcagttggtacaccatcatcccggtaacaagttcaaggttatttttggtggtggcaagcgtgcctttttgccaaatactgaacaggacgaaaaacgatcttatggtagaaggatagataaccggaatcttatcaaagagtgggaggatgataaggtttctcgtaatgtcagccatcaatatgtttggcaccgcgagcagctaatgcgtctaaaggaggacctgcctgaatacatgttgggactgttcgagagcagtcatatgacctatcacttgaaatcagaccctcagtctgaacccactctcgctgaactaacagaggtggcaattcggtcattaagacgcaatgagaagggattcttcctgttcgtggagggggggcgcatcgaccacgcgcaccacgacaacctggtggagctcgcactcgacgagacgctggagatggacaaggccgtggccaccgccacggagatgctctcagaggacgactcgctcatcgtggtcactgccgaccacgcacacgtcatgactttcaatggctactctaaccgtggtcataacatcctcgggccctccagggatgtcggactagacaatgtgccttacatgacgctaacgtatgccaatggacccggattccgtccacacgtaaacaacattagaccagatgttacccttgagccaaactatcgcactctggactgggagtcgcacgtggacgtgccgctggtcgacgagacgcacggcggcgacgacgtggccgtgttcgcgcgcgggccgcaccactccatgttcacggggctgtacgagcagagccagctgccgcacctcatggcctacgccgcctgcatcggccccggccggcacgcctgcgccagtgccgcgcacttgcctagcgcgcacttcttcgtagctctgctcgctctattcacttccattttactgcgataa

SEQ ID NO: 104 - DNA, 1608 bp, Helicoverpa zea
atggtgacactgttcccgtacgtagtggcggtgctgtgcggcgcgacgagcgcgcgcgcccactggctgcatcccgcggcgccggccgccgccagccgcgccgagacctctgccaactactgggcgcaagacgcgcaggccgccatcaacgctcgcctggaacgagttgaaagcgtgaagaaagcgcgtaacgtcatcatgttcctgggcgacggcatgtcggtgcccacgctcgccgccgcgcgcacgctgctcggacagcgccaagggaaaacgggagaggagacaaagttgcatttcgagactttccccacaatcggattagtgaagacgtactgtgtggacgcccagattgcagactccgcatgtactgccacagcgtatttgtgtggtgtaaaaaataactatggcgccataggcgtagacggtacggtacgccgaggagactgtcaagccgcttcaaacactgcgacacacgtcgagtccatcgcggagtgggcgctcgctgacggacgagatgtcggtattgtgacgacgactcgtatcactcacgcgtctccggcgggcacgttcgcgaagacggcgaaccgcacctgggagaacgacggtgaagtgtcgcagatgggcttggacgccaaggactgccctgacatcgcgcatcagttggtacaccatcatcccggtaacaagttcaaggttatattcggtggtggcaggcgcgcctttttgccaaacacagttcaggacgacgaagggtcttatggtaggaggatagacaaccgcgaccttatccaggagtggaagaatgataaggattctcgtaatgtcagccatcaatacctttggcaacgtgagcaattaatgaacctgaatgatgacctgcctgagtacatgttaggtctgttcgagagcagtcatatggaatatcacttgaaatcagatcctcagactgaacccactctcgctgaactaacagaggtggcgattcgatcattaagacgcaatgagaagggattcttcctgttcgtggagggggggcgcatcgaccacgcgcaccacgacaacctggtggagctcgcactcgacgagacgctggagatggacaaggccgtggccaccgccacgaagatgctctcagaggacgactcgctcatcgtggtcactgctgaccacgcacacgtcatgaccatcaatggctactccggccgcggtaacgacatccttggaccctccagggatgtgggacgtgacagaatgccttacatgacgctatcctacactaatggacccggattccgtccacacgtgaatgacatccggcaaaatgttactgcagaaccaaactatcgcactctggactgggagtcgcacgtggacgtgccgctggtggacgagacgcacggcggcgatgacgtggccgtgttcgcgcgcgggccgcaccactccatgttcacggggctgtacgagcagagccagctgccgcacctcatggcctacgccgcctgcatcggccccggccggcacgcctgcgccagtgccgcgcacttgcctagcgcgcacttcttcgtagctctgctcgctctattcatttccattttactgcgataa

SEQ ID NO: 105 - DNA, 3042 bp, Helicoverpa zea
atggcggcgataaaactcttagttttatccttggcttgcgcatgtgtgattgcgcactcgcccatccctccagtcagcaggaccatcttcttagacgagcgtcttgaaggaggtgccttcgagaatatcgacgccttcaagaacatcgaactgagcaacgccgccgcttctccctaccgtctgcccaacactaccttccctacccactacaaagtattatgggttatcaaccttagtgataacgaacaaacctacagcggtaccgtcgatattactcttcaagctacacagccaaatgtcaatgaaattgtcatccactgcgaccacttgacggtcacctctgtggtcttgaggcaaggaacggcaacggaaggaacattgatccccaccacccctacacctcaatctcaataccacttcttgagggtcgcacttaatgatggcgttctcttgtataatgaaaatgtccccgtgcaatataccctttccattgcattcaatgccgaaatgcgtgatgacatgtacggtatctacagaagttggtacaggaacttgcccacagataacaatatcaggtggatggcaacgactcagttccaagccacagctgctcgctacgctctcccttgctacgacgagccagggtacaaggccaagtttgacgttacgatcagacgccccttaggctacaaaagttggttctgtaccaggcagcggatcaccagaccatcaaccactggttacgcagaagatgagtatcacactaccccggaaatgtctacctaccttctagctttaattgttgctgactacgactctcttgcaactctcgatgctaacgatagagttttgcatgaagttattgcaaggcctggagcaattatcaatggacaagcagcctatgctcaaagagctggccaagatcttctaggaaatatgagcgaccacacgggctttgacttttacaaacaggacgaaaaccttaaaatgactcaagctgctattcccgacttcggtgcaggcgctatggaaaactggggcttgctgacttatagggaagcttacattctgtatgacgaacaacacacgagcagcaacttcaagcaaatcatcgcttatattctctcccatgagatcgcgcacatgtggttcggtaacctagtcaccaacgcctggtgggatgtgttgtggctgaacgaaggttttgccagatattaccagtatttcctcactgcatgggttgaagacatgggtctcgccactcgtttcataaacgagcaggtgcacgcatctttgctcagtgactcgtcaatttacgcccatcctctcaccaaccccggtgttggtagcccagccgccgtcagcgctatgttctccactatcacctacaacaagggtgcttctgtcatcagaatgactgagcatcttctcggctttgaggttcatagggcaggtcttaggaaatacttggaggatatgaaattcaaaacagttcagcctattgatttgttcactgctctggagactgccggtaacgatgcaggtgccctcgacgcttatggagatcacttcgacttcgtaaagtattacgaaagctggacggaacagccaggacaccccgtgcttaatgtgcacatcaatcaccagaccggacacatgaccatttaccagcgtcgtttcgacatcgacactggctactcggtccaaaacaggaactacattgttcccatcactttcacgaccggagccgatcccgacttcagcaacacgaagccctctcatgttatctccaaggctgttaccgtcatcgaccgtggagtggtcggtgatgtctggaccattttcaacattcaacagactggtttctacagagtcaattatgatgattacacctgggacttgatcatacttgccttgagaggcgctgacagggaaaagattcatgaatacaaccgtgctcagatcgtcaacgatgtattccaattcgcccgttccggcctcatgacgtacgaacgtgcattgaacattctctcttacttggaaaatgagactgattacgccccatgggttgctgccattactggcttcaactggcttagaaacagattggttggcaaacctcagcttgcagaacttaatgcaaagatcgtccaatggtcatcgaaggtaatgtccgagctgacatacatgcctattgaaggagagcccttcatgcggtcatacttgcgctggcagctagctccagttatgtgcaacttgaacgtacccgcttgccgcgctggtgccagagtcatcttcgataatcttcgtctttatcaacacgaagtaccagtggacagccgtagctgggtatactgcaacgccctccgtgatggtggagccgtggaattcgaccacttgtataataggttcaaggcacacaatgtctacactgagaagatcctcatccttcaaacccttggctgcacaagtcaccctgcctctttgaccacattgctgaacgatattgtcacgcccaacaatatcattcgtccgcaagactacaccacagctttcagcactgctgtttcaggcaatgaagaaaacacactctttgttctcaattacatccagaataacctggagactgttttgaaagcctttacgtctccaagaacacctctatcctacatcgcggctaggctgaggacagttgaagacgttaccgcgtaccaaacttggctgaaccttaccaccactcgcgaggtccttggtaccagttacaataacatctacggagactctgttgccgcttacaacagcatcctttgggtggccaccgttgaggattccctctccgcctatctcactaacggagataacgtcattcagcccactacttctactaccactaccacggttgcaccaaccacagttactcagccccctatcacggaaccgtccactccatctctgccagtaccagtgaccgacggagcaatgacgagcttcgcatcactcttcatcatttcattgggtgccattttgcaccttattttataa

SEQ ID NO: 106 - DNA, 4080 bp, Spodoptera frugiperda
atggatacaaagaaaggaagtaaaaatgactcgaaatccaaaccgccgccgcctaaaccaaagagtgtgccaaacgtgtttaagaggacatttttctgctggatgctgcctatattttactttggcaaccgcagagacctggaggaaagtgatcttccacctcccaagaatatgtatcaatctaagatgctcggagataaattggaaaggagttggctgaaagaagaacatgaagcgaaactagccggacgaaagccgaaatttacgaaggttttattcaaaacattcatttggtcttatataccgggcggtttaatgcaggctacctcaattggcctacgcacggcatctccgctgctgttcagtcaactgctccggtattgggcagctgactccccggtggaccgggagacggccatgtactacgcgatcagtatgatcctcgccaactgggcgtcatccttcatgaaccaccacggagtactgttctgtcagcagtttggtatgaagctgaggtgtgctgttggatctttaatgttcagaaagataatgcgtatgagcaacggctctttaggcgacactgcagcgggtaaggtagtgaacatattatcgaacgacctgcagaggttcgacttgtcaatggtgttcctccactacgtatggattattccgctacaaattgccgcagtcatatatctgggctacctacaagctggaaccgcggctttcattggattcgctgctttaatcatcattgcgttaccattccaaggtggtttgggccagtacctaggtaaaattcgacttcgcaccgctgaaaaaacagacaacagaattaaaatcatgagcgaagttataaacggaatacaggtgattaaaatgtacgcatgggagattcctttccaaaaagtggtcggtcagaaacgtgcggaagagctgaaggaagtgaagattgcaaccatcttgaggaccgtgttcttaggatttatgatgttcacggaaagagctgcgcttttcttcactgtgctcacttatgtcttgttggggaacgttatgtctgctaatgtgttctacccgctgcagcaatttatgagcgccgctcaagtaaacattacattaatcttgcctatggtgctatcgttcactgctgagctcttcgtgtcccttggaagagtcgagaagttcctgttactagaggacaggccagacttgaaggggcatccggaagaaacatcgtccaatttattccgcaacatgtcggccgatggcattccggagaccaacggctctatccgaccgctctcttaccatcggaaatctgaagcatcaccaatagagccgggtagtgagatacagctgaaggttcctaagtttacacggagtgtgtcgtatcaggaggactcagcgctagtgttgcacgatgtgtcggcgagttggaccggagacccgaacatgatggcgctgaagaacatctccatgcgactgcggaagggcaagctgtgcgctatcattggtgcagtcggctctgggaagtcctcgattttgcaactactactaaaagaattgccttcggcgactggcactatttcaatatacggcaagatgtcgtacgcttgccaagaggcgtggctgttccccagcactgtccgggagaatatacttttcggtttgccgtttgaacccggaaaatataagaaggtgtgccgagtgtgtgcactcgagaaggacttcaagcagttcccgtacggggaccagacgttggtgggggagaggggggtgtccctctccggaggccaacgtgcccgaatcaatttggcgcgcgctgtttacagagaggccgatatttaccttctcgatgatccgctgtcggctgtggacgctaacgttgggcgtcagctatttgagggatgtatcaacggttacctgcgtgggcgcactaggatcctggtcacacatcagattcacttcttgaaagctgctgattacatcgttgtactaaacgagggccgtattgaaaacatgggaacatttgacgaattggtttcgtccggcaaagaattcgcaatgatgctcgcccagctacaggaaggcaaagaaaaggacacggagagtgttggctcacggagtatcgaagaaaaagagaaaccagctctgaagaccatgatcagtgtgaatgaaggtgaggaggtacaagagtttgaagcgcagaagatgaaggaagaagagagacaatctggcaacctccgctgggaggtgatctctgcgtacttccgatcgggagggcacgtctgtttcatcctatttgcactcttggtcgttgtactggccactacctgcgccgcttctgttgactactgggtcagttattggaccaatcaaatggctgcatacgaggagtccttgggcggagaaagtatcgagcctggcttggacgtgcaggcgggtcggttcacagtgggacagtatctgacaatccacggctgcctggtggctgccttggtgttgatggtcaacctgcgagtcttccccttcgcctacctctgtgtctcggcctcagccaaactacataaccagatgttctcgactatgctgagaggagtcatgaggttcttcgacaccagttcctcaggtcgtatcttgaatcgttttaccaaagacatgggttctctcgatgagatcctgcctcgtaccttactggatgtactgcagatctacggaaccttgactgctatcctggtactcaacgccattgctctatactggaccctggtaccttcagcagtactcctagtgttattcggctttatggtacgaatatacttgaaggcagctcaaggcattaaacgattggaaggcacaacaaagagtccaatgtttggaacagtgacgtcatcgttgagtggtatttccactatcagggcatccaatgctcaagagagattgatagagcagtttgatatcaaccaggatctgcacactacttcgtggaacagttacttgaatggaggaacgacgtttggtttctatttagatacaatgtgcctggtatacatgaccactatcatattcgtgttcctcttcatcgatttcggggacgccatcccagtgggcagcgtaggcctggcggtgacgcagagcaacacgctgacgctgatgttgcagcacggcgcgcggatgttggtcgagttcctcgcgcagctcaccagcgtcgagcgcatcctcgagtacacgcgcatcgacaccgagccagacttgttccaaggaaaggttgaaatgccgccaaattggccctaccaaggaaggatcgagtttcagaacgtttctttacggtacgcgccgaacgaacaacccgtccttaaaaatttgaacattgttatcgaaagcggaaacaagatcgggatcgtggggcggacgggcgccggcaaatcttctttgatatcagcattattccgattcgcctacctcgatggattaatatccatagatggactcgatacttcgctgatttcgagacagggactgcgatcgaaaatttcaattattccgcaagaaccgatcctgttttccgcgacaatcagatacaatttggatccgtttgacatttacagcgacgacgacctctggagagccctcgaacaggttgatttgaagtctgctgtaccgtccttggacttcaaagtaacagaaggaggttctaatttctcagtgggccagcggcagctgatgtgtttggcgcgcgctgtgttgagatccaatcagatcttaattatggacgaagctacggcgaacgtagatcctcagacggataacttcattcaggagacgattcgccggcagttcgtgtcgtgcaccgtgctgacgatagctcacaggttgaacacgatcatggactccgacaaggtgctggtgatgagcagcggccaggtggcggagtacgaccacccgtacgtgctgctctccgaccctaacagtcacttctctgccatggtgcgggagaccggcgagaagaacagtgctaacttattccaagtagccaaagacgcttacttccaaagtaatctgaaagaaaacgcgagataa

SEQ ID NO: 107 - DNA, 1626 bp, Spodoptera frugiperda
atgaggtcgctactgacttacctagtggccgccgtggtggtggcggcgtgtgtccgcggggaccggtaccaccccgcggaccccggcagcagagctgacaccgttgtgaaccgtgccgagacctcagccaactactgggcccaagaagcgcaggctgcaatcaatgcccggctggcgcacaaggagagcgtgaagaaggcgcgcaacgtggtcatgttcctgggcgacggcatgtccgtgcccacgctcgccgccgcgcggacgctgctcggccagcgccgcgggcacaccggcgaggaggataaactgcattttgaaacattccccaccgttggattgactaagacgtattgcgtgaacgctcagatcccagactccgcgtgcactgctactgcgtacttatgtggtgtcaaaacaacttacggagctattggagtgaatgcggaggtgccacggaaaggctgcgaggcgtccaccgacaccagccgacacgtggagtccatcgccgagtgggcgctggccgacggccgcgacgctggtatcgtgacgacgacgcgcatcacgcacgcgtcgccggccggcgtgtacgccaaggtggcggaccgcaactgggagcacaaccaggcggtggagaacgatggcttcgacacggacaagtgcccggatatcgcactgcagctcgtgcataagcaccccgggaataaactcaaggttattttaggcggaggaagactaaactttttgccaaatgatgtgaaagacgaagaaggggtatatggaaaccgaacagacacccgcaacctcatcgaagaatgggcacaagacaaggaagatcgtaaagttactcataaatatgtttggaatcgtgagcagctgatgagtcttaaagatgatcttcctgagtaccttttaggacttttcgaaagtaatcatcttcagtacaacatgcaggcagatcctaatactgagcccacgttgactgagctaactgagatagcaatcaagtcgctaagtagaaacgagaaaggttttttcctgttcgtggaaggcggtcgtatcgaccacgcgcaccatcgcaactgggtagagctagcgctggacgagaccctggagatggacaaggccgtcgcgcgcgccgccgagctgctctccgaggacgactcgctcattgtggtcacagcagaccactcccacgtcatggcttacaatggatactcggcccgtggacatgacatcctcggcccttccagagacttggacctggacggagtgccttacatgacgctgtcgtacaccaacgggcccggcttccgttcgcatatgaacggtatacgccccgatgtcaccgctgaagacggtttcggagaagacgaatggttggctcacgtagatgttccgctgatagacgagacgcacggcggggacgacgtggcggtgttcgcgcgcgggccgcaccactccatgttcacggggctgtacgagcagagccagctgccgcacctcatggcgtacgccgcctgcatcggccccggcagacacgcctgcagcggcgccgcgcatgcgctggcccagcctgtgctgctgctctctctccttgtactgctcacttcactattccaacaatga

SEQ ID NO: 108 - DNA, 3066 bp, Spodoptera frugiperda
atggcgagtcgctggtttaacctcttattgggggtcattttactccagtctgtgctggcgtttggcccaatcgacgtcacggatgccgaatggattgaatacatggggctgattaataaccccaattaccggttgccaactaccactagaccattacattacaaagttagactgcaaccaaatttagaccaagattttgagcttaacggtgatgtcgaaataaacattaaagttgaaagtgggaatcaaccaatcaacgaaatcaaacttcactgccaggatatggtaatcaacagtttgaccgtaacctcaactacaaatacccaagtaaaccttgctcagggcactcagtttgtatgcgaagaaactacttcctttttaacgattccaaccaccactcagctacttaatggaaatgagtacatcatcaagatatcatttgttggaaagttgcaaagtggtatgagaggtttctacaggagttggttctttgatgaaaataagcagaaaagatggatggctactacccaattccagcctggccatgctcgtcaagcgttcccttgctacgatgaacctggcttcaaagccacatttgatataatattggttagagacgattcacttatttcattatcaaacatgcccataagggaaactataacatctaccttatatccccagaaaaaagaggacatatactacactactcctattatgtccacatacttactggctttcatagtagcggattacaaacggatcgagtctggaacaaatgtgaatagaccattccatatctatgctcgaggtaacgttggagatacaggcaaatattctttggaggtcggtgaaaaacttttgacgttaatggaatcgtatactcaatacaattactacacaatggcttcccacatggaaatgaagcaagctgctattcctgactttagcgctggtgctatggaaaactggggcctgttaacctacagagaagctctcattctgtacgatcctgaaaacagcaacaatttttacaaacaacgcatagccaacattatatctcacgaaattgcacatatgtggttcggtaacctcgtcacatgcgcttggtgggacactctttggttaaacgaaggtttcgctagatattaccaatactacatgacggacaaggctgagccacacatgggctttaagacacgtttcatcgtagaacagctgcaaatggccatgctctccgactccttctcaaatgctcacgcacttactaaccctgcagtgtctgatccagattctgtgagtaaccacttttcaaccatcacttatgccaaaggtgcctctatacttagaatgacagaacatctgcttggtggggacacctatgagaagggtcttcgggaatatttaaagaaaagagaatttaataccgctgaaccaaaggatttattcgaaagcttggacgctgctgctaatgctgacaattctctagctgattacgatgatatgacaattgcgaagtacttcgcatcgtggtctgaaaaagcagggcatcctctattgacagttcatgtagatcacgctagcggccgtatgaccgtcgtacaaactcaatttgatgtcaacagtggtgtgtcttcggacaatggtttatggcacattcctttaacttggactagggctggaaatcctgaatttgaaaatcttaagccttctgaattcatgagtggcccactaaaaattattaaccgaggaagtactggtagagaatgggttattttcaacaaacaacaatctggtttctacagagtaaactacgacgccactacgtgggctcttcttactcaagctttgcgaagtaacgagagggaggctattcacgaatacaaccgcgctcagattgtggatgacgtgttcgtgttagctagatctaacatcttgtcctatacgcgagcgttgaacattctttccttccttgaatttgaagacaagtacgctccttgggtagctgctattactggattcaactttgcgcttcggagactggctcataagactgaagaacaacaaaaactgaaggatataatctttaaatcgagtgcggcgatcatccagcgtctcggttacaccgaggcgtccaacgccgatcctcttttcatggataacttgctccgtatgcatctgatgaccttcctttgtaacgctggacacgcgcaatgctcccaaacaggaagagaatatttcaaggcatggagagagagtgggacaagaattccgccaaacatgcgtccttgggtatattgcgaaggtcttcgcactggagatttagctgatttcgattatttctggaaccgttatgtggatgaagatttatctaacgagaaagtcgtgatgatcggtgcagctggttgcacaggaaatacagaggccttacacaaattcctcagtgtaatcgttgacccaaaaccgactgaacaatcaattgaactaatcagacctcaggactacagcgctgctattagttctgctgttactagcaacgaatacaatactatgaaagtacttgagtggcttaaggataatccttcacatcttcagaatggaaatggcgtaagtcttttacgatctgcagcaagccgattattgaacgaggctgatatttttaaggttgaaacctggtttgccactattacctcagatgaagctatacaagcgattaaagatggcattgctacatcaaataataatataaaatggtataacagtagggtaggggagttcagtgattacttcgaaacaggatattttgacgatttgactggcggatcagaaacacctgatcctactacccctgaacctactaccgctgaacctactacgcctgaaccaactacccctgaacctactaccgctgaacctactaccgctgaacctactaccgatgaatctactcccgctgaacctactaccgctgaacctactaccgatgaacccgaacctggctctgcgaatatcgcttctctcagtttcttcactttgctagtcacactcatcatcaacatggtataa

SEQ ID NO: 109 - DNA, 2297 bp, Diabrotica virgifera virgifera
atgaggacgaaattagtgatttttctgtgtttggtattgtttgtgacaagtgtatacaatgaggatataccagtgaattctttattagatgagctgcatcctgctgcagaattcagccggcatacactcgtgaaacccaaactctaccatggaagagaaaaaagacaaatttcgtcgacgaaagagaagtcgggaaaacacactgatcatctacaaatcacgatggaagtggatggagaggacatgatattagatttgaccattaacaaagatttaattcctgaaggatttttccacaaacatcaaaaaaacggagattacaaaattcatcaaccaacatttcaggaagctaatatctgtgaatacaatggaaaagttcgtggaaagcctaattcctgggtggccctttcgacctgcgacggcctctctggcgtagtattcgacggcgaagagatgcactacgtcgaaaaaggaaattcgataggcgacgtagaggccgatcattttttatatagatattccgatttattggaacacaataagacgtgcgggtatgccggggatgcggtggatcccgaaaaagctattcatgctcataacaataatagaatattaaggtataagagagatacagacgaacaattagtcaggggaccttacaatgccaacaaagaatccaaatatgtagaattagtgctcgtgatagacaatcaagaatacaaagagttgggagaaagtaaaaccaaggttgtaaaccatgccaaaactattgccaacattatcaacggactttactctcccttaaatatttttatagctttagtaggagtagtgatatggaccgaaaacgatgaaattaatttctctcctaatggagatacgacgctcacgaattttctccattatcgaagagagaagcttattaagagtcatcccaacgacaatgctcaattattaacgaaatttaattttgatcatggagttgtgggaaaagcacttaaaggccccatttgtacttacgaattctccggcggggtgaacacggaccattcacctgttgtcggacttgttgctaccaccgtcgcacacgaaatgggccataatttcggtatggaacacgacacgaacgagtgcgaatgcccggacgaccgttgcataatggcgccgagcagctctaccgtcgctccgaaacattggtcctcgtgcagtctcaactaccttctgcaagccttcacccacgggatggattactgcctaaaaaacaagcctaaagcgttattcgacagtcccgtttgtgggaacggattcgtagagccgggcgagcagtgcgattgcggcctggaggaacactgtgataattattgctgtaacgccactacgtgcatgttgcatagtaacgctagctgtgcgacaggagagtgctgtgatcttacgacttgcctaccaaaaggtgcgggaactctatgcagatcggctgactacgaatgcgatcttccggaatactgcacaggacagtccgaatactgccccgaagataattacaagctagacacagaagtctgcgatgacggaaagctttctgttaccatggtttctgcagcaccagatccgaccagtgcaaactgctgtggggagagacgggaaaatccagcgacgaccaatgctacatgatgaacaccaaaggcaccagacacggaaactgtggatacgataagctgacgcagacgttttttaaatgcgaaaatgagagcgtcttgtgtggaatgctacattgcgagcatctcaatgaaaagttggaattcggcatggagtccgtagcgatgttgtcgcacactttcatcaacaaaaagggactgatcatcccttgcagaactgccattgtagatttaggaatcaatcaagtcgatccaggtcttactcctgatggtgctctttgcggcaaagggaagatgtgcgtcaaccagaaatgcatgtcagtctcgagcttaaaaaaacaaggaccccactgccccgacgactgcaacggcaatggctggtgcaacaacaaaggccactgccactgcaaagacggcttcgctccccccacttgcgactatcccggacctggcggctccctggacagcggccctgcagcggatcctaatggtcagtatcttgagaaaaagatttgtgagatcactaacaaagctgccgaaaaatacttgcgatctggcatcaatattaaatgtctcattccgttttgttgtccgccgaaacatcctattagaaatcttattttaaaggatttgggtgattaa

SEQ ID NO: 110 - DNA, 2297 bp, Diabrotica virgifera virgifera
atgaggacgaaattagtgatttttctgtgtttggtattgtttgtgacaagtgtatacaatgaggatataccagtgaattctttattagatgagctgcatcctgctgcggaattcagccgacatacactcgtgaaacccaaactctaccatggaagagaaaaaagacaaatttcgtcgacgaaagagaagtcgggaaaacacactgatcatctacaaatcacgatggaagtggatggagagaacatgatattagatttgaccattaacaaagatttgattcctgaaggatttttccacaaacatcaagaaaatggagattacaaaattcatcagccaacatttcaggaagctaatatctgtgaatataatgggaaagttcgtggaaaggctaattcctgggtggccctttcgacctgcgacggcctctctggcgtaatattcgacggagaagagatgcactacgtcgaaaaaggaaattcgataggtgacgtagaggccgatcattttttatataaatattccgatttattggaacacaataagacgtgcgggtatgccggggatgcggtggatcccgaaaaagctgttcatgctcataacaataatagaatattaaggtataagagagatacagacgaacaattagtcaggggaccttacaatgccaacaaagaatccaaatatgtagaattagtgctcgtgatagacaatcaagaatacaaagagttgggagaaagtaaaaccaaggttgtaaaccatgccaaaactattgccaacattatcaacggactttactctcccttaaatatttttatagctttagtaggagtagtgatatggaccgaaaacgatgaaattaatttctctcctaatggagatacgacgctcacgaattttctccattatcgaagagagaagcttattaagagtcatcccaacgacaatgctcaattattaacgaaatttaattttgatcatggagttgtgggaaaagcacttaaaggccccatttgtacttagaattctccggtggggtgaacacggaccattcacctgttgtcggacttgttgctaccaccgtcgcacacgaaatgggccataatttcggtatggaacacgacacgaacgagtgcgaatgcccggacgaccgttgcataatggctccgagcagctctaccgtcgctccgaaacattggtcctcgtgcagtctcaactaccttctgcaagccttcacccacgggatggattactgcctaaaaaacaagcctaaagcgttattcgacagtcccgtttgtgggaacggattcgtagagccgggcgagcagtgcgattgcggcctggaggaacactgtgataattattgctgtaacgccactacgtgcatgttgcatagtaacgctagctgtgcgacaggagagtgctgtgatcttacgacttgcctaccaaaaggtgcgggaactctatgcagatcggctgactacgaatgcgatcttccggaatactgcacaggacagtccgaatactgccccgaagataattacaagctagacacagaagtctgcgatgacggtaaagctttctgttaccatggtttctgcagcaccagatccgaccagtgcaaactgctgtggggagagacgggaaaatccagcgacgaccaatgctacatgatgaacaccaaaggcaccagacacggaaactgtggatacgataagctgacgcagacgttttttaaatgcgaaaatgagagcgtcttgtgtggaatgctacattgcgagcatctcaatgaaaagttggaattcggcatggagtccgtagcgatgttgtcgcacactttcatcaacaaaaagggactgatcatcccttgcagaactgccattgtagatttaggaatcaatcaagtcgatccaggtcttactcctgatggtgctctttgcggcaaagggaagatgtgcgtcaaccagaaatgcatgtcagtctcgagcttaaaaaaacaaggaccccactgccccgacgactgcaacggcaatggctggtgcaacaacaaaggccactgccactgcaaagacggcttcgctccccccacttgcgactatcccggacctggcggctccctggacagcggccctgcagcggatcctaatggtcagtatcttgagaaaaagatttgtgagatcactaacaaagctgccgaaaaatacttgcgatctggcatcaatattaaatgtctcattccgttttgttgtccgccgaaacatcctattagaaatcttattttaaaggatttgggtgattaa

SEQ ID NO: 111 - DNA, 4266 bp, Diabrotica virgifera virgifera
atgaggacgaaattagtgatttttctgtgtttggtattgtttgtgacaagtgtatacaatgaggatataccagtgaattctttattagatgagctgcatcctgctgcggaattcagccgacatacactcgtgaaacccaaactctaccatggaagagaaaaaagacaaatttcgtcgacgaaagagaagtcgggaaaacacactgatcatctacaaatcacgatggaagtggatggagagaacatgatattagatttgaccattaacaaagatttgattcctgaaggatttttccacaaacatcaagaaaatggagattacaaaattcatcagccaacatttcaggaagctaatatctgtgaatataatgggaaagttcgtggaaaggctaattcctgggtggccctttcgacctgcgacggcctctctggcgtaatattcgacggagaagagatgcactacgtcgaaaaaggaaattcgataggtgacgtagaggccgatcattttttatataaatattccgatttattggaacacaataagacgtgcgggtatgccggggatgcggtggatcccgaaaaagctgttcatgctcataacaataatagaatattaaggtataagagagatacagacgaacaattagtcaggggaccttacaatgccaacaaagaatccaaatatgtagaattagtgctcgtgatagacaatcaagaatacaaagagttgggagaaagtaaaaccaaggttgtaaaccatgccaaaactattgccaacattatcaacggactttactctcccttaaatatttttatagctttagtaggagtagtgatatggaccgaaaacgatgaaattaatttctctcctaatggagatacgacgctcacgaattttctccattatcgaagagagaagcttattaagagtcatcccaacgacaatgctcaattattaacgaaatttaattttgatcatggagttgtgggaaaagcacttaaaggccccatttgtacttacgaattctccggtggggtgaacacggaccattcacctgttgtcggacttgttgctaccaccgtcgcacacgaaatgggccataatttcggtatggaacacgacacgaacgagtgcgaatgcccggacgaccgttgcataatggctccgagcagctctaccgtcgctccgaaacattggtcctcgtgcagtctcaactaccttctgcaagccttcacccacgggatggattactgcctaaaaaacaagcctaaagcgttattcgacagtcccgtttgtgggaacggattcgtagagccgggcgagcagtgcgattgcggcctggaggaacactgtgataattattgctgtaacgccactacgtgcatgttgcatagtaacgctagctgtgcgacaggagagtgctgtgatcttacgacttgcctaccaaaaggtgcgggaactctatgcagatcggctgactacgaatgcgatcttccggaatactgcacaggacagtccgaatactgccccgaagataattacaagctagacacagaagtctgcgatgacggtaaagctttctgttaccatggtttctgcagcaccagatccgaccagtgcaaactgctgtggggagagacggggaaatccagcgacgaccagtgctacatgatgaacaccaaaggcaccagacacggaaactgtggatacgataagctgacgcagacgttttttaaatgcgaaaatgagagcgtcttatgcggaatgttacactgtgaacatctcaacgaaaagttggaattcggcatggagtccgtagcgatgttgtcgcacactttcatcaacaaaaagggactgatcatcccttgcagaactgccattgtagatttaggaatcaatcaagtcgatccaggtcttactcctgatggtgctctttgcggaaaggggaagatgtgcgtcaaccaaaaatgcatgtcagtctcaagcttaaaaaaacaaggaccccactgccccgacgactgcaacggcaatggctggtgcaacaacaaaggccactgccactgcaaagacggcttcgctccccccacttgcgactatcccggacctggaggctcgctggacagcggtcctgcagcggatcctaatgctcgtcaaggcatagtagcagccctcttcatcattttcctaggaatagtacccctggtagcgatatctgcgttcctcctgtactacgttcgccacaacctccatttcggccggcgaaaatcaaccccatcaacgacaaaatcacccagcaaatcaagaggaccaccttttgcttcggaagttacaaaacgaacagaagacaaccattctctgctccgagaagattctccgcctccgattggatttatcggcctatcaaacaactttttcggcaattttaagggattttcgatcattccattaaaaaatgaaactcaaccaagccgatctgctcctccccctcctgttattgtgccagcaaaaagtaagtcatcggcttcatccacttcaaagcctgctaaaccggcagctactcaagaaactaaacacagcatattttcgaaccccatacagaagtataactccttcagaaagagcaacgttccaaacggtattgttactgtaaatcaagtgtctgcagcaccagctttacctccacctaatccaggaagccacgccaagccgataatttcatctccaatactagaaaattcgacctgtactgcaaaagagcttgtatcgcccttacgaaatgctccaaagcttcctattcgggcagcgcctcaagcaccttctatcgaaatcacaagaactttaaacagaataacttcttttcttaaacctgccgataaaaaacctacgattgtatcaaaacctagtcaagtaaaagctactaaagttcttgataaggagtcgctacgaaatatagagatatctaatcctattccacagaaaaacattgaaatttctgtgtctacccttcctgtggatagcgcaacaacaaaaaacgttgtgatgagggcacagagtatgcgagctactaaacagactgacagacccaacatacaaacattcggatctatgagacagccaaatggctacaagagaccacttagcatcccttcagggagccgtcctaaaaatcctccaccacctcgtccaccgttagaaaaatctcaagaaaagtcagcatctgatcagtccgatcagtacgacgattgtttaaacgaagaagtacctctagctacaggtaccaccactagtcctagtggtgataatatttacgctgttatagaagattctccggtagtatccccggaaaataaacctagcaattcaggttctagtgaaagtatgggattactaggtgagattgttaatgaaatacaaagtaggaactttgattcaatttattcaacatcaactttggctcgaaagaagaaagaagaagaggagaagaaaaaagcgcagttgtcgcctgattcttcagagacgtacgtgaatacagcttctctgcagtatccagaaagtgagtacagtaatatgagtggtaatattaagtcaagtgctagttccacttcgagtggttacattctgccatctgctattaatattccggtaaaggaagagacaaaaccaaaagaagaacctaaacctagtttaagctcttttaaagcagactcaaaacctgctgttgtaaataagcctctggcgtcggggtttaagcccagtcaagcaaatttgaaaaaagtagaaacatcaccagaaaggaagtcgaaggtactttcatctcctactagtaaaacaccgccaaagtctgtaagtaggcaaataacgccaccaaacttacgtactaggaaaccttctccgacaaggcctactgctcctgtacataaatccaaccgatcagtaaccaacagtcccgatttggtaacgagctgtaacacaaactcttcgtcgaaacctcctgacatcgttggtaccaactcggttacaaaaaaaccttccattacaagtgctaaacctacagtgcccttacctaaagttaaaagtaaccctaaggcagttaacgctaaggtgtcgcaggaaaagaaaggcgatgccaaaccagtggtagctaataaactcaacaagactagtacttcggacagtactaccaaaacttcggtaggtgttagaaacgcagctagatcgaactctaatgttgcttctttacaacaaaaattcgagaataagacgtaa

SEQ ID NO: 112 - DNA, 3921 bp, Diabrotica virgifera virgifera
atggacacggggaacaagaccactaagccccgcaaccctgcggaaaataccaatccgatttcttttctcttctttttctacatgttccctatcttcaaaaaaacgtacaagtacaaattaacagaagaagaactattttctccgttgaaggagcacacatctagtagactaggatcaaaattagaaaaagcatggaaagaagaatataggatacacaaaaagactgcactacatagggctttatttaggatatttggacttagatatacggtcttagggttaatcagattgttcgacgaactcttgttaatagttgtaatgccttactgtatacgaacgctagttgcatatttggaagcaggacagaccaaaataacgaaagatgaggcgttaatttatgcagctgcacttgtgattacacttttactagatgctgtgatgcaacaaccaaactatatgggcttacagcacatcgccatgaagatacgagtggcttgctcgtctttgatatataggaaaactttgaggtttagccgagaagctttaggaaacactactgtaggtcaattagtaaatttattatccaatgacgtaagcaaatttgaccagttatttggtttgactcattacgcctggatagggccaatccaagtcgctcttgggacgtggctattgtatagagagattggagtgagtgccttttttggtatggcgatcctagtggcgttcgtcccgcttcaaatttggttagccaaaaaaatgtctgtgatgcgtctgaaaacagctttgaggacggacgaaagggtcaaactaatgaacgagattatctccggtattcaggtgattaaaatgtattgctgggaaaaaccgttcgctcatgttattgatttggcacggagatccgaaatgcgtgcaatcagatcacactcctgcctattaggaatactatattcattcgaagtattcgtgtccagaactgctatatttgtgagcatcgtaggctacgtccttctcggtaattatgtatcagccgataaagtttttgctattaccgccatctacaaccagatgagaacaatcattaccatcatattttctctaagtataacagcattggccgagatgcacgttactatagataggatacataagctaatgatatttgacgaacgagaacaagactctgaagatggttatgaaaagatgaatggtaactatcaatctaaactgaacggactagatggcatgaagaacggtattaacggaaacggtacagctattgaattaattaaaaaagtcaaagagcctaaattgatgctatctggagtttctgccaagtggttagcacagtctcctgaaaataacctaagtgacataacattcaatgtccctcctaataaaatgctcgcgatcattggaccagttggtagcggcaagagcagcatcataaacttaatactaaaagaactaccagtaaaatcaggaaagctagaaatagatgggaaagtgtcttatgcctcccaggagccatggctttttgctgcgagcgtacgtcaaaacatcttgttcggtgaggaatatgacgaagaaagatacaaactggttgtagaagtatgtgccttaaaatcagattttgccttattcccccacggagataaaactttggttggagagaaaggaaaagctctaagtggagggcaaaaagctagagtgaatttggctagatgcgtgtacaaaaaagccgacatatatcttctagacgatcctctatcggctgttgatgctaacgtaggaaaacatctctacgatagatgcatcaaacagttcttgtcaaacaaaatatgtgttctggttacacatcagctacagtacttaagaaacgccgataagatcattatcatgaaagatggtaagatggagatgactggaagctacacagaactaaagaagagcggtctagacttcgccaaagttatggaagaatttaacgaggaagccgaagaagacaaacggatgaagtcaattaaatcaaaagcgtcaatttacgatgagccaatggaagatgaagaggaccaagttctggagaaggaaatgcaggagaagggtaccattaaggcagctacttattatttgtacttaaaagcaggcggtgggatttgttcgatgttagcactgggcttcctgtttattatttgtcaagtagttgctaatgccggagaatactatgttacttattgggtgaacttagaacaagattttagcgagaagcaaagaatgaatttaaccgcccccaatgaaactataaacagggatctgatcatgtggtcttacactgcccttatcgttggtaacataatcatatcggtagtcaaggcagtgtactttatgatttttttcgtaatagcttctaagaatctacataaatatatatttgacaaactaatcaaagcgacaatgagattttacaacacaaatccatctggaaggatcctaaacagattttcgaaggatctaggaactgtggatgaatatttgccttctgttatcattgatgttattgagattgcattacttcttcttggagctattacactatctgcaatagtagagcccttattgactgtacctgcagtggtgctaatgataattttctatttattgaaaatagtgtattctgaaaccagtagaagtgttaaaagagttgaagcaattacaaaaagtccaatgttgagtcacctcacagcttcagttaatggattgagcacagttagggctttccacgctgaaaaaatgttaacggaagaattcgacaactaccaggacagccacagtgcagcatggttcttatatttggcttccagtaaatgttttggactttggttagatataatctgtattgtcttcatagctgtggcagtattttcgctcttgttgttccgagacacaatccatggaggtgatttaggtttagtcatcactcagtatctgggtctaatgggctcactccagtggggaatgcgacaatggaccgaactagaaaacaacatgacgtcagtagaaagaattttggaatacacccgtttggaaacagaacctgaacggaaagaacctaaaaatattcctcagccgtggccggagaagggtcttgttgaattcagagacgtcagtttgcgatacagtccacaggatccgcctgtacttaagggactgaactttacagtacagcccaaggagaaaattggcatagttggaaggactggggctggtaaatcgtcaaccataacggctctctttcaactctatccacttgaaggaactgttgtggtcgatggtgtagatacgacgcaaataccgttggatttggttaggactaatatttcgattataccacaagaaccagtgcttttctcaggtaaaatgcgtgaaaacttggatcctttcgaaaattacagcgatgacgtattatggaacgccttagatcaagttgaactgaaagatgtaatatccgaactgccagcaggcctcaatacagaagtcacagaaggaggaaataacttcagtgttggccagaggcagttggtttgtctggcgagagctcttattagaaataataaaattttggtcatggacgaagctaccgcgaatgtggatccacataccgattctttgattcagaaaaccataagggataagtttgcggattgtacggtgctgacaattgcccacaggctacatacggtaatggattctgacaaaatattggttatgaattccggcagagtggaggaatttaatcatccatatcttcttctacaaaacgtacatggtgtgcttcacaatttggttgacgctactgggccttctactgcaaagaatttagaaaacatagccaaagagagttacgagaagaaaagagtttaa

SEQ ID NO: 113 - DNA, 2805 bp, Diabrotica virgifera virgifera
atgtgggtaatacttctcttatccatacttgcttcagcaacggcttcaaatccagatctggcttcttcagatacagatccagatctatttcccgtacaaagagcgactgaagaagcagaaatctccagtaacaagtacttgttatcatcaccagttattcccacacactatgatgtcggcttaacagttcccttggaggctttatctggaggtagtacaaattatgacggaactgttgatataactttgagtgttattaacgcaacgaatgttgttcaattgcactcacttgtaaacatcgttagcataacctttactgattcgtctattgtgatacacaattatacactcaacccaaacctggaaacgatctctatatttttaaacagtaccctaaatgctaatgcgatctacaagctcaatattaagtttaatgcaagtttagaaaaagttaacatgaggggattttatagaagtgactatattattaacggtactaaagagtatctggctacaacgcaatttcaggcaacttctgctagaagagcatttccttgttttgacgaaccaggattgaaagcaacttttcagttgactctaacccatccctcggaattcaatgctaagtcaaatacaccatcccagtcgcaggcagtagtacaagcaacaaatactacgacaactgtttttgaaaaaaccccggtgatgtctatatacttgatagccatcgtaatttcaaaatttaattgcacgtcaagtacaaatttaggtacaaattttggggtatgttcaagaaccgatttatctaacgacagaaatgaagccttaaaatatggtatgaaaattttagaagcgtttgatacgtacactgctagtccatacaatttaaccaacttaaagaaattggatcagttcgccattcccgattttagtgctggagccatggaaaactggggtatagttacttacagggaatactcacttatctggaacaatgaacaaacatcaagagctttaaggcaaagtttactttccatagtcgctcatgaatttgcacataactggttcggaaatctggttactacaaaatggtgggataccactttcttgaacgaaggattcgcgaggtatttccaatacttcattttgacaaaaattactgatttaagtgactttcaaatggataaacaatttatagttgaacaacaacaaacagcatttatagaagatgcgtcccctctttctcgctcacttacgtccgaagcatggacaccggctgaaataagcaacaaatttaatacaatatcttataacaaaggtgcatgtgtctttagaatgatagagaacttgattggttctgttgcttttcagacagctttgcaaaaatatctaaatgctactgcttatggttcaggaaccacggaaaaattatgggccaattttcctaacagtattgcattacctccaaatgtaaattttaccgattttgtagataattggacaaataaacctggattcccagtcgtgaatgcagttttcaatggaaaaaatgttacattttcacagaaaagattcttatacactggaaataataacactcagtggtacataccggttacttacagattgtcaaatagctcttcatatgaaacattttggttggcacccaatagttctgtaacaatactaaataatttaactgacaaagactggttaattgtaaatgatgattctagaggttattacagagttaagtattgcaaaaggctaacgcaaagaatacaatctctattaaatcaaaatcacactcaaatttcggagttaaacagagctcaaatactagacgactctcttaatcttgctagggctggatacattaaatactccgaagctttcgagcttctggaatatttaaaaaatgaaactagctacttcccttggttcactacgattaaaaatatggattatttagtaacaagattaggagccaataccgagttgggaaaaagaacaaatgctatgatattagaccttataagtcagatttcagccaacatttcaactactaaatgggaagaaattgatcaagttactactttgaaattgcaaagggtgtgggcagatgcttgtaaaagaggccaggcaagttgtatttctgagacaaagagactgtttcaggcattaagattaaacaaaactagcgtaaatccaaatataagagacgtagtatactgtaatgccttgagaaatagtaacaatattgccgctgattgggagttcctgtggaacagactattgatctctattcatcctcaggaagatctttacatattactgagtttgggatgcacaacacacaagccctacttaacaagattattggatgcaaccataaactctacatcagtaataaaacttcaaaacctatataccgtatggaattcagttggttctgccagtaaagaaggtttagatcttgcttttgaatatttcgttaacaactacaaaaaaattattgaatattatcccgatggtatatcattattatctcaattggccaacagatttacaactaatgctgaggtcacaaagttgcaacaattcgctgatcggctggagaagaactcaacaatcagagctgttgcaaattcagctttaactacagcaagacagaatttacaatttagggctcgaattgaagatgacctgaacgattacttcaagattgataactccgggtcatcagtaactcctcttggaatatttatgcctttattattgttaagtgtagttttctttatgtaa

SEQ ID NO: 114 - DNA, 783 bp, Diabrotica virgifera virgifera
tatgacgagcaggttttctttagtgtcatgacaggatctatgaactttggtattgcctctccatatatagaggcatttggaatctcaaaagcggcggcgtcaaaaatttttagtgtaatcgatcacaaacctacaattaatttatcaaaaggaaatggaaaaacgctaaacgtactcataggaaatatacaatttaaagatgtggctttccgttatccatctaggaaagatgtaccgatattaaaaggattaagtttgaacattaaatctggagacactgtggcacttgtaggtagttcgggctgtggaaaatctacggttattcagttacttcaacggttatacgatgcggactctggagaggtcaccatagacggaaaaaatattaaagaatacgatttaacttggttaagaagccaaataggagttgtaggtcaagaaccaattctctttggaacatccattttagaaaatattaggtacggtaaagatggagtaacagaggaagatgtcattcaagcagctaaaaaagctaatgcgcataactttattaaagctcttcctaacggatataatacattggttggagagaaaggggctcaactctcaggtggacaaaaacaaaggatagctatagctagagctttggtaagaaatcctactttattacttttggacgaggctacttcagcactggataataccagtgaagctaaagtacaagcagctctagatgcggcaagtgttgaatgtacaactataattgtggcacacaggctatca

SEQ ID NO: 115 - DNA, 783 bp, Diabrotica virgifera virgifera; identical to SEQ ID NO: 114

SEQ ID NO: 116 - DNA, 3970 bp, Diabrotica virgifera virgifera
atggaaatgaccaaagagaaatataatcccaatccacgggagactgcgaatattatatcggctctattttttggatatacgtatgatgtatttaagaagggcttatcgaagacgctggaagttgacgatttatataatccgttaaagagtgacagaagcaaagtcttgggagataatttacaaagaaattgggacaagcaactagaaaaatctaagaaatcaaattccaaaccaagtttattgaaagccattgttatgtcattttggttggagtacgcaaagctaggaatatatactatcacgacagatttagtgctaagactcattcaacctctaatacttgggaacctattggattattttaaaccagaatcacaagtttccgaaaatgaggctcttacgtatgcaggtatcctagtggccataaacatcttgaacattttgatgtcaaatcaatatatgctagaggtttttcacagtggcatgaggataagagcatcttgttgtgctgtgatatacagaaagtcattaaaattgagcaaaacagccttgggagaaacagcatccggaaaactggtcaacctattatccaacgatgtcagtagatttgatattgttagtttattcattcaccaattatggatggcacctgtattgtcacttatagtaatgggtatactgtaccagagaactgggtatgcaggagtagtgggagttgtggcagtatttgtgatagttccctttcaaacctacaccggaaaattatctgcaatatacagaaaacagactgctttcaaaacagacgagagagtcagactaatggacgaaatcatctcaggaattcaagttatcaaaatgtacgcatgggaaataccgttcaggaaaataatccgaattgccagacgaaatgaaataaaaattattacaaaatctgcttatgtgagagctacgtttatggcattgaatcttttcaccaccagattggcattgttctgtactttgctgacagttattttgtcgaacgaagaaatcacagcgtcgaaggtttttgttgtaatgggttatttcaacgttctttcaatggctatgtccaccatgtttagtagaggagtatctgaaatggcagaggttatggtagctattcgaagaattagagattttctcataaacgaagaatacgatcctaatagaacaaatttcgctatgaatggcaatgtaaacagtgtagacgattttaaagaaattataagtttgcaaaatttgactgtaaaatggaatgcaagcttcagtgacaatgctcttgagaatataaatataaatatttctgatggacagatggttggaattattggacctgttggtagcgggaagagttcattattgcaaacattactgggggaactggacataaccgaaggcagtatgagagttcgaggtcaaatatcctatgcttctcaggagccgtgggtttttgcgtccactgttcgtcaaaacattctttttggtgaagaatacgacaaaaagagataccatgaagttatagaagcttgctctttagagaaagattttgagcagttcccaaatggagatttaacactagtaggtgataggggatcatctttgagtggcggccaaaaagctagaataaatttagcaagagctgtgtatagagaagccgatgtatatctcttggatgatccgttgtcagctgtggacatacacgtttccaaacatctatatgaaaaatgtattaatggatatttggccaacagaacgagaattttagttacccatcaagtacactatttgaaagatgcggataacattattattttaaataatggacgcatagaagatgaaggaaccttcaattttttggcaaacagtgacaatgtttatgcaaaacttttaactgctgagccagaaaatgtagaagaaaagaaacaagatagatctaaatataataggcaactctcaataagaagtcgaaaagattcactggcaagtatagtcagtgaattaagcattgcggatactctcatatcgaatgatatcgactttgaagaagaagaagctgaaaagcaactcgaatttgatgtcaaagaccttcaggaacaatcatcaaaaggaaaagtgggcggttctctgttgtttaaatatatgttggcaggttctaattcatttgctgttttaatatgcgttatattgtatctaggaactcaattagctgccagtggggtagactactgggtaagctattgggtcaacgtagaggaattcaggagctccagcgaatcttctaattctactacacctacattcattattccatccattgaactgacaacaaataattgcctttatatatatgggttccttttaggagctctttttgttcttgctatgacaagatctttcttcttttataaacttgctatgtggagctccaaaaaactgcatgcgacaatttttgataatattgtcactgctacaatgagattcttcgataccaatccaggaggaagaattctcaacaggttttctaaagatatgggatgtgttgacgaattactaccgaaagcaatattggattcttcacagatgcttttgtctatgtgtggatctctcttactgatagtcgtagtcaatccttacttcttaattctgattggcgccttgagtgtagttttggttttatgaggcatgtctacctaaaatcttcgaagaatattaagaggttagaaggaataatgagaagtcccgtgtttacccatttgagagctaccattgaaggtttgacaaccataagagcttttggagcccaaagtactcttatggacgagtttgatcatcaccaagattatcattcaggtgcatggtacatgtttatagtttccagtaatgcatttggattttatttggactgtttctgttctctttttttggcagcacttacttttagtttactattatttggggaggcctttaatctgaagggaggtcaagtaggtctggccatcactcaagcaacagcattaacaagtttactacaatggggtatgcgtcaatctgccgaggtaaccaatcaacttatgagcgtggaaagggtattggagtaccaaaatttggaaaaagaaccacaaccggtcgtacctcaaaaaccagcaaaagaatggcctcagaaaggagaaatcacttttaaagatacttgtttaaaatactttgagggtggaccattggttttgaaacatcttgatcttaaaattcaaccaaaggaaaaggttggagttgttggcagaaccggtgcaggaaaatcttccttaattcaggcactctttagactagccccaattgaaggttcaattaaaatcgatgacatcgacaccaaagacattagcctcaatgatctccgtttaaaaatctcgattattccccaagacccagtgctattttcaggaactttaagatacaacttggacccattcgaagaatattcagacgaagttttgtataaagctatacaagacgtagaactaaaagatcctgctaatgttattaaccgattggaaaatagagtcatggatagaggttccaattacagtgttggacagagacagttgatttgcttggcaagagctattcttaaaaataacaaagttcttatgttggatgaagctacggctaatgtagatccacagactgacgctttaatccagaaaactatcagaagaaagttctcagattgcactgtgataaccgtcgcacatagactgaacacaatcatggactctgataaagtattagttatggacgctggacaaatatctgaatttgatcaccctcacttactccttcaaaataaaacggagttttttacagtatggttgctgaaactggtagaacaacagctgaacagctaagaaaaattgcttcagatagttatcaaaaactaaatgcattaccagagtaa

SEQ ID NO: 117 - DNA, 3972 bp, Diabrotica virgifera virgifera
atggaaatgaccaaagagaaatataatcccaatccacgggagactgcgaatattctatcggctctattttttggatatacgtatgatgtatttaagaagggcttatcgaagacgctggaagttgacgatttatataatccgttaaagagtgacagaagcaaagtcttgggagataatttacaaagaaattgggacaagcaactagaaaaatctaagaaatcaaattccaaaccaagtttattgaaagccattgttatgtcattttggttagagtacgcaaagctaggaatatatactatcacgacagatttagtgctaagactcattcaacctctaatacttggaaacctattggattattttaaacctgaagcacaagtttccaaaaatgaggctcttacgtatgcaggtatcctagtggccataaacatcttgaacattttgatgtcaaatcaatatatgctagaggtttttcacagtggcatgaggataagagcatcttgttgtgctgtgatatacagaaagtcattaaaattgagcaaaacagccttgggagaaacagcatccggaaaactggtcaacctattatccaacgatgtcagtagatttgatattgttagtttattcattcaccaattatggatggcacctgtattgtcacttatagtaatgggtatactgtaccagagaactgggtatgcaggagtagtgggagttgtggcagtatttgtgatagttccctttcaaacctacaccggaaaattatctgcaatatacagaaaacagactgctttcaaaacagacgagagagtcagactaatggacgaaatcatctcaggaattcaagttatcaaaatgtacgcatgggaaataccgttcaggaaaataatccgaattgccagacgaaatgaaataaaaattattacaaaatctgcttatgtgagagctacgtttatggcattgaatcttttcaccaccagattggcattgttctgtactttgctgacagttattttgtcgaacgaagaaatcacagcgtcgaaggtttttgttgtaatgggttatttcaacgttctttcaatggctatgtccaccatgtttagtagaggagtatctgaaatggcagaggttatggtagctattcgaagaattagagattttctcataaacgaagaatacgatcctaatagaacaaatttcgctatgaatggcaatgtaaacagtgtagacgattttaaagaaattataagtttgcaaaatttgactgtaaaatggaatgcaagcttcagtgacaatgctcttgagaatataaatataaatatttctgatggacagatggttggaattattggacctgttggtagcgggaagagttcattattgcaaacattactgggggaactggacataaccgaaggcagtatgagagttcgaggtcaaatatcctatgcttctcaggagccgtgggtttttgcgtccactgttcgtcaaaacattctttttggtgaagaatacgacaaaaagagataccatgaagttatagaagcttgctctttagagaaagattttgagcagttcccaaatggagatttaacactagtaggtgataggggatcatctttgagtggcggccaaaaagctagaataaatttagcaagagctgtgtatagagaagccgatgtatatctcttggatgatccgttgtcagctgtggacatacacgtttccaaacatctatatgaaaaatgtattaatggatatttggccaacagaacgagaattttagttacccatcaagtacactatttgaaagatgcggataacattattattttaaataatggacgcatagaagatgaaggaaccttcaattttttggcaaacagtgacaatgtttatgcaaaacttttaactgctgagccagaaaatgtagaagaaaagaaacaagatagatctaaatataataggcaactctcaataagaagtcgaaaagattcactggcaagtatagtcagtgaattaagcattgcggatactctcatatcgaatgatatcgactttgaagaagaagaagctgaaaagcaactcgaatttgatgtcaaagaccttcaggaacaatcatcaaaaggaaaagtgggcggttctctgttgtttaaatatatgttggcaggttctaattcatttgctgttttaatatgcgttatattgtatctaggaactcaattagctgccagtggggtagactactgggtaagctattgggtcaacgtagaggaattcaggagctccagcgaatcttctaattctactacacctacattcattattccatccattgaactgacaacaaataattgcctttatatatatgggttccttttaggagctctttttgttcttgctatgacaagatctttcttcttttataaacttgctatgtggagctccaaaaaactgcatgcgacaatttttgataatattgtcactgctacaatgagattcttcgataccaatccaggaggaagaattctcaacaggttttctaaagatatgggatgtgttgacgaattactaccgaaagcaatattggattcttcacagatgcttttgtctatgtgtggatctctcttactgatagtcgtagtcaatccttacttcttaattctgattggcgccttgagtgtagtttttggttttatgaggcatgtctacctaaaatcttcgaagaatattaagaggttagaaggaataatgagaagtcccgtgtttacccatttgagagctaccattgaaggtttgacaaccataagagcttttggagcccaaagtactcttatggacgagtttgatcatcaccaagattatcattcaggtgcatggtacatgtttatagtttccagtaatgcatttggattttatttggactgtttctgttctctttttttggcagcacttacttttagtttactattatttggggaggcctttaatctgaagggaggtcaagtaggtctggccatcactcaagcaacagcattaacaagtttactacaatggggtatgcgtcaatctgccgaggtaaccaatcaacttatgagcgtggaaagggtattggagtaccaaaatttggaaaaagaaccacaaccggtcgtacctcaaaaaccagcaaaagaatggcctcagaaaggagaaatcacttttaaagatacttgtttaaaatactttgagggtggaccattggttttgaaacatcttgatcttaaaattcaaccaaaggaaaaggttggagttgttggcagaaccggtgcaggaaaatcttccttaattcaggcactctttagactagccccaattgaaggttcaattaaaatcgatgacatcgacaccaaagacattagcctcaatgatctccgtttaaaaatctcgattattccccaagacccagtgctattttcaggaactttaagatacaacttggacccattcgaagaatattcagacgaagttttgtataaagctatacaagacgtagaactaaaagatcctgctaatgttattaaccgattggaaaatagagtcatggatagaggttccaattacagtgttggacagagacagttgatttgcttggcaagagctattcttaaaaataacaaagttcttatgttggatgaagctacggctaatgtagatccacagactgacgctttaatccagaaaactatcagaagaaagttctcagattgcactgtgataaccgtcgcacatagactgaacacaatcatggactctgataaagtattagttatggacgctggacaaatatctgaatttgatcaccctcacttactccttcaaaataaaaacggagttttttacagtatggttgctgaaactggtagaacaacagctgaacagctaagaaaaattgcttcagatagttatcaaaaactaaatgcattaccagagtaa

SEQ ID NO: 118 - DNA, 3972 bp, Diabrotica virgifera virgifera
atggaaatgaccaaagagaaatataatcccaatccacgggagactgcgaatattatatcggctctattttttggatatacgtatgatgtatttaagaagggcttatcgaagacgctggaagttgacgatttatataatccgttaaagagtgacagaagcaaagtcttgggagataatttacaaagaaattgggacaagcaactagaaaaatctaagaaatcaaattccaaaccaagtttattgaaagccattgttatgtcattttggttggagtacgcaaagctaggaatatatactatcacgacagatttagtgctaagactcattcaacctctaatacttgggaacctattggattattttaaaccagaatcacaagtttccgaaaatgaggctcttacgtatgcaggtatcctagtggccataaacatcttgaacattttgatgtcaaatcaatatatgctagaggtttttcacagtggcatgaggataagagcatcttgttgtgctgtgatatacagaaagtcattaaaattgagcaaaacagccttgggagaaacagcatccggaaaactggtcaacctattatccaacgatgtcagtagatttgatattgttagtttattcattcaccaattatggatggcacctgtattgtcacttatagtaatgggtatactgtaccagagaactgggtatgcaggagtagtgggagttgtggcagtatttgtgatagttccctttcaaacctacaccggaaaattatctgcaatatacagaaaacagactgctttcaaaacagacgagagagtcagactaatggacgaaatcatctcaggaattcaagttatcaaaatgtacgcatgggaaataccgttcaggaaaataatccgaattgccagacgaaatgaaataaaaattattacaaaatctgcttatgtgagagctacgtttatggcattgaatcttttcaccaccagattggcattgttctgtactttgctgacagttattttgtcgaacgaagaaatcacagcgtcgaaggtttttgttgtaatgggttatttcaacgttctttcaatggctatgtccaccatgtttagtagaggagtatctgaaatggcagaggttatggtagctattcgaagaattagagattttctcataaacgaagaatacgatcctaatagaacaaatttcgctatgaatggcaatgtaaacagtgtagacgattttaaagaaattataagtttgcaaaatttgactgtaaaatggaatgcaagcttcagtgacaatgctcttgagaatataaatataaatatttctgatggacagatggttggaattattggacctgttggtagcgggaagagttcattattgcaaacattactgggggaactggacataaccgaaggcagtatgagagttcgaggtcaaatatcctatgcttctcaggagccgtgggtttttgcgtccactgttcgtcaaaacattctttttggtgaagaatacgacaaaaagagataccatgaagttatagaagcttgctctttagagaaagattttgagcagttcccaaatggagatttaacactagtaggtgataggggatcatctttgagtggcggccaaaaagctagaataaatttagcaagagctgtgtatagagaagccgatgtatatctcttggatgatccgttgtcagctgtggacatacacgtttccaaacatctatatgaaaaatgtattaatggatatttggccaacagaacgagaattttagttacccatcaagtacactatttgaaagatgcggataacattattattttaaataatggacgcatagaagatgaaggaaccttcaattttttggcaaacagtgacaatgtttatgcaaaacttttaactgctgagccagaaaatgtagaagaaaagaaacaagatagatctaaatataataggcaactctcaataagaagtcgaaaagattcactggcaagtatagtcagtgaattaagcattgcggatactctcatatcgaatgatatcgactttgaagaagaagaagctgaaaagcaactcgaatttgatgtcaaagaccttcaggaacaatcatcaaaaggaaaagtgggcggttctctgttgtttaaatatatgttggcaggttctaattcatttgctgttttaatatgcgttatattgtatctaggaactcaattagctgccagtggggtagactactgggtaagctattgggtcaacgtagaggaattcaggagctccagcgaatcttctaattctactacacctacattcattattccatccattgaactgacaacaaataattgcctttatatatatgggttccttttaggagctctttttgttcttgctatgacaagatctttcttcttttataaacttgctatgtggagctccaaaaaactgcatgcgacaatttttgataatattgtcactgctacaatgagattcttcgataccaatccaggaggaagaattctcaacaggttttctaaagatatgggatgtgttgacgaattactaccgaaagcaatattggattcttcacagatgcttttgtctatgtgtggatctctcttactgatagtcgtagtcaatccttacttcttaattctgattggcgccttgagtgtagttttggttttatgaggcatgtctacctaaaatcttcgaagaatattaagaggttagaaggaataatgagaagtcccgtgtttacccatttgagagctaccattgaaggtttgacaaccataagagcttttggagcccaaagtactcttatggacgagtttgatcatcaccaagattatcattcaggtgcatggtacatgtttatagtttccagtaatgcatttggattttatttggactgtttctgttctctttttttggcagcacttacttttagtttactattatttggggaggcctttaatctgaagggaggtcaagtaggtctggccatcactcaagcaacagcattaacaagtttactacaatggggtatgcgtcaatctgccgaggtaaccaatcaacttatgagcgtggaaagggtattggagtaccaaaatttggaaaaagaaccacaaccggtcgtacctcaaaaaccagcaaaagaatggcctcagaaaggagaaatcacttttaaagatacttgtttaaaatactttgagggtggaccattggttttgaaacatcttgatcttaaaattcaaccaaaggaaaaggttggagttgttggcagaaccggtgcaggaaaatcttccttaattcaggcactctttagactagccccaattgaaggttcaattaaaatcgatgacatcgacaccaaagacattagcctcaatgatctccgtttaaaaatctcgattattccccaagacccagtgctattttcaggaactttaagatacaacttggacccattcgaagaatattcagacgaagttttgtataaagctatacaagacgtagaactaaaagatcctgctaatgttattaaccgattggaaaatagagtcatggatagaggttccaattacagtgttggacagagacagttgatttgcttggcaagagctattcttaaaaataacaaagttcttatgttggatgaagctacggctaatgtagatccacagactgacgctttaatccagaaaactatcagaagaaagttctcagattgcactgtgataaccgtcgcacatagactgaacacaatcatggactctgataaagtattagttatggacgctggacaaatatctgaatttgatcaccctcacttactccttcaaaataaaacggagttttttaaaagcatggtttgtgaaactggaagagcaacagctgaacagctcaaaaaaaattgcttccgatagttatcaaaaactacaagcactaccagagtaa

SEQ ID NO: 119 - DNA, 3972 bp, Diabrotica virgifera virgifera; identical to SEQ ID NO: 118

SEQ ID NO: 120 - DNA, 2805 bp, Diabrotica virgifera virgifera; identical to SEQ ID NO: 113

SEQ ID NO: 121 - DNA, 2808 bp, Diabrotica virgifera virgifera
atgtgggtaatacttctcttatcaatacttgcttcagcaacgacggcttcaaatccagatttggcttcttcagatacagatccagatctttttcctatacaaagagcggccgaagaagtagaaatctccagtaacaagtatctgttatcatcaccagtaattcccacacactatgatgtcggcttaacagttcccttggaggctttatctggaggtagtacaaattatgacggaactgttgatataactttgagtgttattaacgcaacgaatgttgttcaattgcactcacttgtaaacatcgttagcataacctttactgattcgtctattgtgatacacaattatacactcaacccaaacctggaaacgatctctatatttttaaacagtaccctaaatgctaatgcgatctacaagctcaatattaagtttaatgcaagtttagaaaaagttaacatgaggggattttatagaagtgactatattattaacggtactaaagagtatctggctacaacgcaatttcaggcaacttctgctagaagagcatttccttgttttgacgaaccaggattgaaagcaacttttcagttgactctaacccatccctcggaattcaatgctaagtcaaatacaccatcccagtcgcaggcagtagtacaagcaacaaatactacgacaactgtttttgaaaaaaccccggtgatgtctatatacttgatagccatcgtaatttcaaaatttaattgcacgtcaagtacaaatttaggtacaaattttggggtatgttcaagaaccgatttatctaacgacagaaatgaagccttaaaatatggtatgaaaattttagaagcgtttgatacgtacactgctagtccatacaatttaaccaacttaaagaaattggatcagttcgccattcccgattttagtgctggagccatggaaaactggggtatagttacttacagggaatactcacttatctggaacaatgaacaaacatcaagagctttaaggcaaagtttactttccatagtcgctcatgaatttgcacataactggttcggaaatctggttactacaaaatggtgggataccactttcttgaacgaaggattcgcgaggtatttccaatacttcattttgacaaaaattactgatttaagtgactttcaaatggataaacaatttatagttgaacaacaacaaacagcatttatagaagatgcgtcccctctttctcgctcacttacgtccgaagcatggacaccggctgaaataagcaacaaatttaatacaatatcttataacaaaggtgcatgtgtctttagaatgatagagaacttgattggttctgttgcttttcagacagctttgcaaaaatatctaaatgctactgcttatggttcaggaaccacggaaaaattatgggccaattttcctaacagtattgcattacctccaaatgtaaattttaccgattttgtagataattggacaaataaacctggattcccagtcgtgaatgcagttttcaatggaaaaaatgttacattttcacagaaaagattcttatacactggaaataataacactcagtggtacataccggttacttacagattgtcaaatagctcttcatatgaaacattttggttggcacccaatagttctgtaacaatactaaataatttaactgacaaagactggttaattgtaaatgatgattctagaggttattacagagttaagtattgcaaaaggctaacgcaaagaatacaatctctattaaatcaaaatcacactcaaatttcggagttaaacagagctcaaatactagacgactctcttaatcttgctagggctggatacattaaatactccgaagctttcgagcttctggaatatttaaaaaatgaaactagctacttcccttggttcactacgattaaaaatatggattatttagtaacaagattaggagccaataccgagttgggaaaaagaacaaatgctatgatattagaccttataagtcagatttcagccaacatttcaactactaaatgggaagaaattgatcaagttactactttgaaattgcaaagggtgtgggcagatgcttgtaaaagaggccaggcaagttgtatttctgagacaaagagactgtttcaggcattaagattaaacaaaactagcgtaaatccaaatataagagacgtagtatactgtaatgccttgagaaatagtaacaatattgccgctgattgggagttcctgtggaacagactattgatctctattcatcctcaggaagatctttacatattactgagtttgggatgcacaacacacaagccctacttaacaagattattggatgcaaccataaactctacatcagtaataaaacttcaaaacctatataccgtatggaattcagttggttctgccagtaaagaaggtttagatcttgcttttgaatatttcgttaacaactacaaaaaaattattgaatattatcccgatggtatatcattattatctcaattggccaacagatttacaactaatgctgaggtcacaaagttgcaacaattcgctgatcggctggagaagaactcaacaatcagagctgttgcaaattcagctttaactacagcaagacagaatttacaatttagggctcgaattgaagatgacctgaacgattacttcaagattgataactccgggtcatcagtaactcctcttggaatatttatgcctttattattgttaagtgtagttttctttatgtaa

SEQ ID NO: 122 - DNA, 2996 bp, Diabrotica virgifera virgifera
atggttgggaaggttgattattcaagtgtgccaacttcggcagacttagaaaacaactcgaaccaaaagaaatacacagtgaaccaaaacggtaaacaaggcgttgtgataccgagatccctctgcgccctaatggcgatcggtgccttactattagctatactagtaggtctaatagtattcttcttagttcctagggattgtcatgcgacgaaatcccctcaagcattaacacatcaaccgccacagagcgctagcgtactgaatattaatagtaggggtagtagtagtaataatgatgacactaaggctgaaacgacgattgcaccgatagtgacgaaagtggaggttgaacaaaggctgccaaggagtatagaacctacacattatcgattacgaatattgccgcattttcaaaattctacgagtgagggttcagtgactatgactctgaacgttttagaagacacgaatgaaatcatcttcaacagcagaagcattttaatcgatgagcattccgttagcataagatcaaccaaacccgattctagtctgttagaaataaaggagcagctatactacgagaaggaaaaattaaaatagtactgaaagagcatttaagaaaaaatgaagagtaccaattagatttaaattttaatgggaagttgagtggacatttgcaaggattttataggataaaatattacgacgagtaccacaggcaaaggttaattgcctctacacagttttctccagttgatgcaagaagtgcttttccatgcttcgatgaaccatcgttcaaggccaatttccaaataactataggacgaccagctgacatgttatcactgtcaaatatgccgttggcccagaaaactccattttcaacgaacaactcagaactatggagttgggacgaatatcccgaaacccccaagatgtcaacgtatctagtcgctttcatggtaatggacttcattaaaggtgctggagacgatccccgaatgatgttttgggcacgaccacaaatcgctggaaactctgcttatgctgcccagataggacctaaaatcctcagtttctatgaaaactattttggcattaagtttccgctatctaaaattgatattgtagctgttcctgagtttggtttcagtgctatggaaaattggggccttataacattcagggaggatgttctcttatacgatcaacaatcatcaactaatgaggacaagagaactacagcaacaattttagcccacgaactagcacatcaatggttcggtaatctcgtgactccagtattttggaacgatctctggttgaaagaaggtttttctaatttcttggtatactcaggagtaaactatgctgaaccaaaatggatgtttgctgaagaattcatgctatctgaaaatctcgacgctatgagtgaagacgctttgcaaacttctagaccaatttccttcgataatattcaaaacacagttcaaattcgacagttattcgatcctatcacatatcgaaaaggagctgcaatagttaacatgataagcaacttccttggagaaaaaactttcaaaaccggtcttactaactttttgactaaatactcttacaaaaatgctgatagaaacgatttatttgcatctcttaccgaagaagcacataacagacagatcttgctaccaaatgaaactgttaaaatcattatggatacatggacagaacgagcagggtatcctgttatatatgcttatgctgattatgaacagaacacacttagactgtctcagaaaagattcctttaccgaatgagggacgaaaagtcaagctactgggttccgttatcatttactactaatgtaaagccaaattacactgacactttccctaaattttggctgaagggcgagtatgaaaccgtgcaaaatgttaacttatcggatatcaaatggtacctcctaaatttaaaccaaacaggttactttattgtcaactacgacgaaagaaactggatgagtctcgtcgaagccatcatggaagtgccaaccagcatcagggcgcagttgatctcagactccatggatttagcaagggcaaacatcattagctacgacatacccctaaggatgattgctaagatggcgattcgtgacaataacattatgtttgtaccaacagcgatagccttcgagaagctgaagtacttaagtgatatcctttcttcaacgccagcgttcggatttttcgagagtttccatcaaactattttcaaagaatcgtacaaaaaggtggcattagaagatcctttcgacgactatagaacaagaagaatccgtacaacagtactcaactggtcgtgtagaagtagtgagacaagatgcgcacatctctcaaaaatccagttcagacaatggatggtgggagcaaagagggttgaaccaaatctccagcaaatcgtctattgcacagccctaagggaaggaggacagatagaatgggattttgcctacaagaaatatatagaaatcacatctccaacagagaaaagcactttgctggacgctttgggatgtacaagacacacatggctgctctccagatacgttgataaaatcctgaatgatcccagtattcgcattcaagatgcagatcgagtttttcaatcggtggctaacaacaagtttggcacgcagatagcgtttgatttcttgagaactaactgggtggcgttactcaaacatcatggtgatggtttcaacgtcattgcgaagatggtcaaagctcttggaccacaaatgaacactgaattccagttgtcagagttaataagattccgggatagtatccacagcaacagcagctcggcatcagaggcaatcgcttcaacgatagaaacagtccgaggcaacgtagaatggatgcagaagaactaccaccaagtagagcagtggcttcgaaaaaacaagaacaatttcgatactttataa

SEQ ID NO: 123 - DNA, 1125 bp, Diabrotica virgifera virgifera
atgattcttatactgttcgcgttttccgcgatactttttaacggtgtacattccgtatgtcttaaaaattcgataacaactgcaagtggtttacacgcacccaagaacaagagtctctgttctggtcaactgatctttgaagacaactttaattggttggacacctcgaaatgggaccatgaacaaaccttaactggtggtggaaacaacgaattccaatggtatacggataatagacgtaacagttatacttacaacggccaattacacatcaaacccacttttgtcgcagatgaatatggagaagatttcttatattctggtactattgatataggagctgcctgcacaggtggcgacaacgaaggttgcagaagaactggttcacccaatgccatagtcaatcccatcgtaagtgctcgtatgaggacattgcactcattctcatttaaatacggcagggttgaagttaatgctaaaataccatctggagattggttatggccagctgtctggatgttaccaactaactgggagtatggaaattggccagcatctggagaaatcgacatcatggaaagtagaggaaaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggaggaactagaatggctccatttgacaaagagttccatcttataattaatttggctattggaggagcttatttcaacgatgaatttgacaataaagcttataagaaaccctggactagcactgaaccttaccgtcagggtatgacaaaattctggcaagctaatcaaaaatggaaaccaacctggaatttgaactcagatgactcacatcttaaggttgattacgtaagagtttgggctttgtaa

SEQ ID NO: 124 - DNA, 5067 bp, Diabrotica virgifera virgifera
atggctacgagaaatctatgtttatgtatgcttatttggatgccactctttgagggcatagttggcgacgtcgcctttggcattgcacaaattcctggtggtaaggcaacagtagaagatttgaaaaaagggaaatacttacttaacatggaagaaaataatcatggcggcgtaataccaactccactttttactattacaggggtggacaacactgattgtcctaatttgaatgttgaatttactcaaggcatgaagtttaagttttcgattaatgaaagttgtatattctatgctgaacagacatttgactacgaatcgaatgaaagatcatacaatttcagaatttcaaagtccgtaaatgacgagatagatattgcattcagtatcaaaaatatcgatgatgaacctccacaattaggaacgtttaaatgcaactttaatgaacaattagactatagtcttgatgacacaccatgcaatactacattgcatgatcccgacggatggctggcacaagagaaaattttaatattcatcgacactaaggatgaagatatattcgcaattgatttgcgaaagcctctaccaaatgatactgagacagacacctacgtttttatgtatctcttaaagcaacttaattatgaggataccaatttttatcagtttacagtgcaagcaaatgattctggaggtaatctttcaccacaagaaagtgctgtggtaaatgttatcaacattagaagtagacctccaaaatggtcaaaaataacattatttgatcaatttgacgaactgaccgaacaagattacgatatacaagctttagatggagatactggaattcatgcagatatttgttatgcaaaactaggtgaagatttaccagacaattacataaacgtcagtaccgataaaaccaataaaaaaggccatattcacgttaatcccattgatagagataaggatgatctaacactataccattttaacatttctgcctatgtttgtgatgccccagactattttactgtaaatacagtgcagtattacatcatcgatattgacaataatcctcccaggatagttgaaaatgttggggatgacggaaagaacacaacatttgacgatgataacgaccataaaaatgttacactaagttatttggaaaattattcgagatcgtataattttagcacaaccattacagatagagatacgggcgaaaacgcgcaattcactgtaagtctcgaaaatgttgagggttctacggttgattatacacaaccctatctaatagtaccggacaatgcttacaagacaggatcattcataataagcgtgaaaaataagaccttcctggatttcgagaacgacacttggaaaaagcattcctattatgttgtttccaatggaaaaaaagacaaatcaaagactgacagaatgttaatatcagtctcactagaagactataacgatgaacttcctattttcgagaaagaatcatacacaacagaaataaatgagactgttgcgaacggcactcaaatactatacacccatgcaacagacagagatgcagaagatttcgaactgaaaatgaatatagttggaacttatgctgagaataggctaagtattgataaagatggaaatattaaagtaaaggtagtcaatgccttcgattacgatgtcttaaattctgtgtatttccaagtaaccgcaacagataaggttaatcatgtgactagagtaccagtaacgattaacattttggatgttaataataaagctcccgtaataaatcaagtggaccatatacaaatcgaagaaaaccaacaaaacggtgtagtgctaaatgtaacaataacagctacggatgtagataccacggctaatctgactgctactataaattgggaagattccaaagttaccaaaactaatggtgctgtagtaaaaactgacgctgtaataaaagctatgcaatttttagagatagaaaatacacaaacagatgacggtctggaaatgaaactaaaggtaataaataataatgacgataatccagacaagccagattttgaaactttcgatacattgtatttaagtatagttgttgaagaccgtaatactgatcctgattttgaacaaaatcgatatacagaaggtcaaattgtcatcaatatccttgatgttaacgataatccaccatattttccaccttctaatgatgacactcgacaggtccaggaaatgtctctgaaaggagtatcggttggctccataaaagctgtcgatgttgatttgaattcagaaattacctaccattgcacgcccgaatatgaaaagtttgactgggtcgatgtaaatcttacaactggcgccataactgtaaagaacgataaacaagttgacgcagacacagacaaaacgtattatttcaactatacttgttgggctcatgatggtgtgttcttttccaaaccgttagacatctcaatctatgtcatcgacacaaacaacgaagtacctgtaatagattttccaaatgaagtacacgtaaaggaaaaatcacttatagatacagtaattaaaaagattgttacaagtgatttagatagagatgagccgtttcgtactgtaaactgtaattttgcaagcgatactgatccagactgtcaaatagaattctatattgataccaatgttcttaaagtgaaaagaaataaaactcttgatcgtgataagggaagaaaaacatatccttgtctatttgagtgcttggataatcctttaaatgttcgatcccaaggacaaaataaagccaataaaagctttactataatattggatgatataaatgatcatgcacctgtgcttatgacgaaggacctacaatgttctgaaaatttgaataaggacggcgaagtaggagagggcataataggagaagatattgatgatggtgataatgctaaaatagatttttctgtgttaagtatcgttgataaggaaaccaaaaatgacattcaagaatcttttaatatttctaaaattgatagtgattatgtattgaacgatacattgaagaaagtgcatcttatagccttcgaagatctcaaaggaaaatatggaacgtatgaagtcactttacacatgcatgacgaaggagatccaatgcagacaacagatccggatccaactttaacacttacaattgaaaaatggaattaccaaacaccaagtataatatttcctgaaaacgatcaaacatacattgtcctatcggatcaacaacctggtcaaccattggcactgtttaacaacactggaacttcaaatactttgcccgattttagtgcaacagatggtgaaacgaaggactgttctaagtgggatgtgaaattttcttatacgcagactaattatgaagatgataaaattttcgtgatagaccatatacagccgtgcgtttctcaactacaagtcagcaaacatttcaactcggatctagtacgaagtaaaaagtataagctaactattacagccagtgttaaggatggagcagaacaggaaggtgaagcaggttactcgacatcagcaaatataagtatagttttcctcaacaacgacgctcagccgatctttcaaaatagtgactggagtgtatcatttgttgaattcaatacaacacaacctgcgaaacctttggaagaacaggctgagtatgagaacacgaaaggaggacttcctatctattaccatttctattccgaaaaccagaccctttccaaatattttgaggttgatgagacgtccggtgatttatcggttataggaaatcttacctatgattatgatcaagatatatcgtttcacatagttgcttcgaatgactcacaagtcagaatgttggatccacgatccagtctaaatgttactgttaattttcttccacgtaaccgcagagctcctcagtggaaaagtaccaaattctttggagcagttatgcctacattcgtaactgggaacctcatagtcaccgctcaagctcatgacgacgattatatcgatcaacaacgcggattaacgtgttctatatctagtgagattaaccgaattggggaaggattagataaaataataggcgaaccattttatttgagcactgaaaatgatgccgccaaaatatttttggactttacagtgcagactacaatgaccggtcgatttgaatttaaaatcaaagtagaggacaatagagatgactacggcaatggtccatttgaaagtgaagctgatacaacaatatttattattactaaagacaacaccgttgattttcaattttacaacgatattgaggatgttcaggacagagaaacaccgatgttaaaaataatatccgatatagtgggatatgatgcatatcgtcaaaatatagatacagtaacaaatagcggtctcgttaggaccagagcaaggctttatttcattgacagtaaaagcagccgtcggttgcaacgcactaaaagtcccgcagacagtggattcgaactggttaatagtgaaacaatattaaacatagtgaccaatgtgaacaccttccaaaatctggccagcaccttgagaagtgaacaaaaactgaacctcgacagctttgaaacgaattccaaatccggcaacagcgaagcagcactaagagcttggttgatcggagtgtccgtggtcttggggatcttggtcttgcttttactaatcactttaatactaaaaaccagacagttaagtaacagaattaaaaaactaactaccccccaatttggttctcaagagtctggacttaacaggatgggcataaatgcacccaccaccaacaagcatgccatcgaaggaacaaatccagtatacaataataacgaaatcaagaagccaaaaaatatgaacgattttgatactcacagcataagaagcggtgattctgatttggttggaatagaaaacaacccagagtttgactacaacttcaacactaacgaggataaaactacatatctctaa

SEQ ID NO: 125 - DNA, 3774 bp, Diabrotica virgifera virgifera
atgggaacaaaaaaggatgatattaaggaaaaaaagacaaatgctctagatgcaaaatttgtaaaaaagaaagaaaatgagacaaaaattaaacctatatctttttttggaatgtttaaatatgccagcaaaggggacaaactcctgatgtttattggaactctatcggcagtaatcactggttgtctaccaccaataaatacaattttattcggagaacttgcaggaaatgctgtgcaatatgctgaaactttatataacgctaccttatcacaaaacgaacaagctgaggctcaggaaaaattctttgatggtattaaatttttcgctttggcgaatagtatggtcggagttgcgatgctttgttttagttatctttctaccatcacttttaattattcatcaacgaaacaaatatttcaaattagatctgattacttaaaatcaattcttaaccaagatatatcatggtatgatcaaaatcaaacaggcgattttgcaagtcgaatgtctgatgatttgtccaaatttgaagatggaataggtgaaaaggtaccaatgtttatacattttcaagtactctttgtagcagcagtaggaacagcattggccaaaggatgggagctagccttgatatcactggtagcaataccagcatccttggtatcttttggagtgataaatttgttaacaacaaaattagccaaaaacgaaatggaagcctacgcagcttcaggttcaattgctgaagaagtattttcattgatcagaacggtaacagcttttggtggacagcaaaaagagattgacagatataaggagcacctggtgtctgcaagaaaaaataatattaagcgaacaatgatcgttggtatcggattcggattggtgtatcttctattatatagtagttatgcactgtcgttatggtatggggtaaagttggtgttaaaagacaggtttaatcctaatgctagttatactccagcgaatatggtaacgatatttttcgccgtattgtcagcttccctgaactttggtgcagcttccacatatttagaaatgtttgccatatccaaagcagctgctgccaaaatttttaatgtaattgaaagcaaacctgatataaatttatcaaaatcaaatggggcaaaattggatcatttgaaagggaatattcaatttaaaaatgtcaaatttcattatccatctagaccagatataccggtactacaagggctggatattgaaattaatcctggggagactgttgctcttgttggaagttcgggatgcggcaaatctacggttgttcaacttatacaaagattttacaatgccgtatctggtgagatcttagtcgatggaacaaatattcaaaatttggatttaacatggtaccgaaacaatataggcgtagtaggacaagaacctgttttgtttggtacaaccatcctagaaaacattcgatacggaaaagaagaagctacagaagaggaaattatagaagccgcaaaaaaagcgaatgctcatgcttttattaagttgttaccaaaaggttataatacactggtaggagaacggggaacccaattgtctggaggacaaaaacaaagaatagctattgctagagccttggttcgaaaaccgactctattgttgttggatgaagcgacatctgcattagataatgctagtgaagctaaagtacaagaggctttagatttggcgagtgctgaatgtacaacaataattgttgcccatagactgtctacaataagaggagctaacaagattatagtacttcttgaaggaactgtagttgaacaaggaacacatgatgaattaatatcattaacaggtgagtattttaagcttgtaactgcccaagttgcaagttccaatcagatcgaattatcaaatgatgaaacagaaacaaaaggcaataatgaagcatatgaagaatataacgacgattatgatgacatatctcacgatgaaaaaaatgaaatagatgactttaaaaatggcaaaaaaattactctttttagcatcatgaagttaaatgcaccagaatggccatatattttaattgctggagtaggatctatagtagttggttggggatggccaatatttgctgtgttctttggtagtgttcttggaacactggcaaaatacgatacagagtatatagaaacagaaactacaagatattgtatatttttcgtgattgcgggtgtcatatgtatgatctcagtatttcttcaaaattatctgttaggaatagcgggagagaaaatgacagaacggattcgaacccagatgtttacagcaataatatcccaagaaatgggtttctttgacaaaaaatctaacggtgttggggcattatgcgcaaaattagctggagattcatccagcattcaaggagctactggacaacgagtgggtgcaatactgcaatctctttcaacgttcggtatagcaatagctctgtcaatgtattaccaatggaaactaggtctgttaatggcatcctttacaccattaatgttggttgcaatatttatagaaaaacgtaacactacaggtctaagtgaggccagagaaaagtccttacaaaaatctacaaagattgcagttgaagctgtgggaaatataagaactgtggcaggtcttgtcgcggaggataagtttcaaaaaagttatattactgaattgaaaccccactacaaagcagcgttagcagcagtgcattggagaggactagtttttggactgtcacggagtcttggatattttgcttatgctgctgccatgtactatggcggttttcttatacgagatggactatattatgataaagtatttaaggttgctcaagcacaattgatgggaaccatttcaattgctaattctctagcatttacgcctaatttaaacagaggtataagtgctgcgaagaggataaagagtttcctatccagaatcccccttatcagagatggtccaagttcaaaaccaatgaaccaggtagacggtaatataggttattcaaacgtagagtttttctatcccacaagaaaaaatattcaagtactccgtggtctgactatcaatattccaaaaggaagtactgtagcacttgttggtgaaagtggatgtggaaaatccactattatacaacttatagaacgattctacgatccatcttctggagatattaatttagatgaacaaaatattaaacatataactttaagttcgttaagatctcatttaggaatagtgccacaagaaccaaatctttttaataagtctattgctgagaacattgcctacggagacaactctagaaatgttcccattgatgaaattattcaggctgcaaagaacgcaaacattcataattttatagttggattacccaatgggtacgatacagaattaggagaaaaagcaactcaattatcgggtggacaaaagcaaaggattgcgattgctcgtgctttggtacaaaatccgaagattttactcttagatgaagctacatctgctttagacacagaaagtgaaaaggtagtacaagcagctctcgatgaagctaagaagggaagaacatgcatcacaatagcacacagactgacgaccattcaagatgcagatataatatacgttatcgataaaggaatcgttgttgaatcgggaacccacagagagttattaaataaaaatggtttttattataaattgtatactcaaaaacattaa

SEQ ID NO: 126 - DNA, 3870 bp, Diabrotica virgifera virgifera
atggacacggggaacaagaccactaagccccgcaaccctgcggaaaataccaatccgatttcttttctcttctttttctacatgttccctatcttcaaaaaaacgtacaagtacaaattaacagaagaagaactattttctccgttgaaggagcacacatctagtagactaggatcaaaattagaaaaagcatggaaagaagaatataggatacacaaaaagactgcactacatagggctttatttaggatatttggacttagatatacggtcttagggttaatcagattgttcgacgaactcttgttaatagttgtaatgccttactgtatacgaacgctagttgcatatttggaagcaggacagaccaaaataacgaaagatgaggcgttaatttatgcagctgcacttgtgattacacttttactagatgctgtgatgcaacaaccaaactatatgggcttacagcacatcgccatgaagatacgagtggcttgctcgtctttgatatataggaaaactttgaggtttagccgagaagctttaggaaacactactgtaggtcaattagtaaatttattatccaatgacgtaagcaaatttgaccagttatttggtttgactcattacgcctggatagggccaatccaagtcgctcttgggacgtggctattgtatagagagattggagtgagtgccttttttggtatggcgttcctagtggcgttcgtcccgcttcaaatttggttagccaaaaaaatgtctgtgatgcgtctgaaaacagctttgaggacggacgaaagggtcaaactaatgaacgagattatctccggtattcaggtgattaaaatgtattgctgggaaaaaccgttcgctcatgttattgatttggcacggagatccgaaatgcgtgcaatcagatcacactcctgcctattaggaatactctattcattcgaagtattcgtgtccagaactgctatatttgtgagcatcgtaggctacgtccttctcggtaattatgtatcagccgataaagtttttgctattaccgccatctacaaccagatgagaacaatcattaccatcatattttctctaagtataacagcattggccgagatgcacgttactatagataggatacataagctaatgatatttgacgaacgagaacaagactctgaagatggttatgaaaagatgaatggtaactatcaatctaaactgaacggactagatggcatgaagaacggtattaacggaaacggtacagctattgaattaattaaaaaagtcaaagagcctaaattgatgctatctggagtttctgccaagtggttagcacagtctcctgaaaataacctaagtgacataacattcaatgtccctcctaataaaatgctcgcgatcattggaccagttggtagcggcaagagcagcatcataaacttgatactaaaagaactaccagtaaaatcaggaaagctagaaatagatgggaaagtgtcttatgcctcccaggagccatggctttttgctgcgagcgtacgtcaaaacatcttgttcggtgaggaatatgacgaagaaagatacaaactggttgtagaagtatgtgccttaaaatcagattttgccttattcccccacggagataaaactttggttggagagaaaggaaaagctctaagtggagggcaaaaagctagagtgaatttggctagatgcgtgtacaaaaaagccgacatatatcttctagacgatcctctatcggctgttgatgctaacgtaggaaaacatctctacgatagatgcatcaaacagttcttgtcaaacaaaatatgtgttctggttacacatcagctacagtacttaagaaacgccgataagatcattatcatgaaagatggtaagatggagatgactggaagctacacagaactaaagaagagcggtctagacttcgccaaagttatggaagaatttaacgaggaagccgaagaagacaaacggatgaagtcaattaaatcaaaagcgtcaatttacgatgagccaatggaagatgaagaggaccaagttctggagaaggaaatgcaggagaagggtaccattaaggcagctacttattatttgtacttaaaagcaggcggtgggatttgttcgatgttagcactgggcttcctgtttattatttgtcaagtagttgctaatgccggagaatactatgttacttattgggtgaacttagaacaagattttagcgagaagcaaagaatgaatttaaccgcccccaatgaaactataaacagggatctgatcatgtggtcttacactgcccttatcgttggtaacataatcatatcggtagtcaaggcagtgtactttatgatttttttcgtaatagcttctaagaatctacataaatatatatttgacaaactaatcaaagcgacaatgagattttacaacacaaatccatctggaaggatcctaaacagattttcgaaggatctaggaactgtggatgaatatttgccttctgttatcattgatgttattgagattgcattacttcttcttggagctattacactatctgcaatagtagagcccttattgactgtacctgcagtggtgctaatgataattttctatttattgaaaatagtgtattctgaaaccagtagaagtgttaaaagagttgaagcaattacaaaaagtccaatgttgagtcacctcacagcttcagttaatggattgagcacagttagggctttccacgctgaaaaaatgttaacggaagaattcgacaactaccaggacagccacagtgcagcatggttcttatatttggcttccagtaaatgttttggactttggttagatataatctgtattgtcttcatagctgtggcagtattttcgctcttgttgttccgagacacaatccatggaggtgatttaggtttagtcatcactcagtatctgggtctaatgggctcactccagtggggaatgcgacaatggaccgaactagaaaacaacatgacgtcagtagaaagaattttggaatacacccgtttggaaacagaacctgaacggaaagagcctaaaaatattcctcagccgtggccggagaagggtcttgttgaattcagagacgtcagtttgcgatacagtccacaggatccgcctgtacttaagggactgaactttacagtacagcccaaggagaagattggcatagttggaaggactggggctggtaaatcgtcaaccataacggctctctttcaactctatccacttgaaggaactgttgtggtcgatggtgtagatacgacgcaaataccgttggatttggttaggactaatatttcgattataccacaagaaccagtgcttttctcaggtaaaatgcgtgaaaacttggatcctttcgaaaactacagtgatgacgtattatggaacgccttagatcaagttgaactgaaagatgtaatatccgaactgccagcaggcctcaatacagaagtcacagaaggaggaaataacttcagtgttggccagaggcagttggtttgtctggcgagagctcttattagaaataataagattttggtcatggacgaagctaccgcgaatgtggatccacacaccgattctttgattcagaaaaccataagggataagtttgcggattgtacggtgctgacaattgcccacaggctacatacggtaatggattctgacaaaatattggttatgaattccggcagagtggaggaatttaatcatccatatcttcttctacaaaacgtacatggtgtgcttcacaatttggttgacgctactgggccttctactgca

SEQ ID NO: 127 - DNA, 3852 bp, Diabrotica virgifera virgifera
atggattccacaaaggaaacctacaatcccaatccaagggacagttccaatatattctcaatattattttttgggttcacgtatcccatattcaagaagggcatgaagaaagactttgacgtggaagatttgtataacccattgaaaaatgacagaagtactcttttgggagataagttagaaaggaattgggacaaacaaaaacttaaaccaaaaggcaaacccagtctcctccgagcagtagcaattacatattggtacgaatatctacgattagggttcctcacattgataggagatgtttttattcgagtaagccaaccttacgttttgggcttgttgctcacctattacaacccacattccaaaaccaccaaggaacaagctctagggtacgctgggatgatagttacttttaatactctaacgtcgtttataaagaatcagtatatgatgaattctatgcacgctggtatgcgagtaaggacttcggtgtgtgctcttatttatagaaaggctatcaaattaagcactactgccctcggcaaaagttcagtagggaagattgttaatcttctttcgaacgatgtaagcagattcgattcagcctcgatgttactgcaccaaatgtgggttggaccagtttctgcaataataattatgtatatcatttttcaagatattggatggtccggagcaactggagttgttaccattgttacaattatgcccatgcaagcgtatattggcaaattatcagcaaaatatagaagaataatcgctggtaaaacagatgaaagaataagactgatgaacgaggtcatagggggcattcaggtgattaagatgtatgcgtgggaaataccgtttacaaaattaatcagccttgcacgaaaagctgaaattaatgttattagaagaagcgcgtacataagaggtgtatttatggctttcaatttattcaacaatagatttgctttgtttgcaactttggctacgatggtatttactaacaaagctatcacggcagcaagagtgtacgtttttatgtcatattaccaaatcctagctaacacactagctggagtattcgtcaatggtcttacacagattgctgaacttctagtttccattaacagaatcgaagagtttctcgaaaatgaagaacacaaagaattacctgccctaaaaagatctgtaatctcgaacgtcaatgaagagatggtagcttgtaagaatatggttgcgtcttggaatgaaaactcacttgatcctgttttgaaaaacctaaattttaaacttggaaaaaatactctacttggtgttattggtcctgttggcagtgggaaaagttcattgctacagtctattttgggtgaacttgatatagttgacggaagcctagccgtccacggcacactctcctacgcctcccaagaaccttggatcttttccggcagtattaggcaaaacattctttttggttccgactttgacaaagcccgctatgatgaagtattaaaagtatgcgaactcagaaaagattttgaccaattccccgaccgagatttcactctgataggagagaaaggcgccaatctcagtggtggtcaaaaagctaggattaatctagctcgtgctatttacaaagatgctgatatatatttactggatgatccactttctgccgttgacagtattgtttccaaagtattatatgaagactgcattaatggatttttagctaagaaagcaagaatattagtaacccatcaagtttattatttaaaaactgctgatcacattctcgttctcaataatggaggcatcgaaattgaaggcacctattcagaactactaaaaagcgacaaccctctcactgtccacttaaccgaagaaatcgaagaaattttaaaacgtcaaaagtctcaagattctgctatagaagaacaggaagctaagactatgagcacgatggatctttccaaaatgaatggaaaaatgaaagccattgtcaaagaaatgcaagaagaaacatctaaaggaaaagttaaaggttccttattcctcgaattctttaagtcgggcatgagcatctgcgaaataatatttttagttactcttcttactatagctcaagccagcgccactgttatagattggttcattagtttctggacgaatatcgaagagtaccagatgacattgaactctaccgcagctaatgtattaaactctaccgtagttgatgcattaaactctaccgcagttgatgcgataaactctaccgcagttgatgtgttaaattctaccactgtgaatgcattaaactctactgtagttgatgaaagtgtgcccttttacatgaattggagtagccaaacttgtttgataatttatggtgcaattttagtcttttgcttggttacaacgttatccaggtcacttagtttttacagatttattctaaattgttctgagaatttacacggcatgttgttcactggagtaactaatacatatatgagattttttgataaaaatccaagtggaagaatcttgaatcggttttcaaaggatattggttctgtagatgaaatcttgccaaggatgttattcgaagcttctagggtcaccctcaaaatgcttggacacttggtattagtcctttacgtaaacccggcatcagttatcgttgtaataatattgggaattttgttttcctttattaggatagtctatcttcgatcatccaacaatattaagcggctcgagggaagaatgaaaagtccagtctttagtcatctgacagctacattggaaggactcaccaccataagagcctttaaagctcaaaacatccttagagcagaattcgacaagcaccaagatagccacaccagtgcttggttcatgtttattagtaccagttctgcgtttggattttcattggatgtcatctgtttgatgttcattggatcgttaaccttcagtttgattgggctgggtgaatattttaatttaaccggtggtgacgtgggtctagctattaatcaagcttcgtcgcttactcaaaacatacaatttctggttcgtttctctgctgatatctccaatcaactaatgtcagtggaaagaattttagaatataaagaattgataccagaacagcaaccggaaaaactactgttacctccaaaaagttggccggataaagggattgttaatatagaacatttaaatatgaaatatatagatgatggtcccactattctaaaagatgtcagtgttaagattaatccaaaagaaaagattggtattgtgggcagaactggagcaggaaaatcttcattaatatcagccatattccgattgactcctctagaaggtaaaatctacattgacgatatcaataccaaagacataacactaaaacagctaagatctaaagtttcaattataccccaagatcccatcttgttctccggcaccttgagatataatctagatccctttgatgaatacagcgatgaaactttgtacagagccttgaacgaagtcgaattaaaggatccgagcaacattattaatcgtttggaaaacagggttatggacagaggatcaaactatagtgttgggcagaggcagctaatatgtttggcgagagctattataagaaataataagattttggtcttggatgaagctactgcaaacgtggatccacagactgatgctctaatccaaaggactattagagaaaagttcgcagattgtacagttttaacagtggcacatcggttgaacacaatcatcgacaatgaccgaatattggtgcttgaagcaggagaa

SEQ ID NO: 128 - DNA, 2907 bp, Diabrotica virgifera virgifera
atgtcaaataaaatagtgactttagctttccggactgaagccaaaaaattcttaaccgttttacataaaccgttagcttacaacagaaataaaaattggttcagtagaacttctaaagtaccgttaccgttaggaaaggaaagcagaaacgtccctggttcagtccccttcaaaaaccgtcgcaccaatctcctgcgcttgccgcaatcggttgctgtgtcagtggggcgaagtcaacattattgttgtagtgagtggttaagttctataagttatagtaagagacgtctctcagttcagaaaacatcgaaaaatatgcctgaaggaaaacctttcgaaaggttgccgcaaaatgttaaacctaaaaactaccgcctgtccctcgtgccagatcttacagccctgactttccaaggaaatgtttctatagaagttgaggttgttagcaacacggatacagttgtacttaattcattagacttaaaattaaacgaggttactttaaaaggagataaatccctaaaacctggtcaagtagaattatgtgcggaagaagaaattgcgactttaaaatttccctctttagtgaccccaggctcctacattttagatatagcatttacaggtgaaattaacgacaaaatgaaagggctatacagaagtaaatatgtaaaccaaaaaggagaggaaacatacgcagcagtaacccaattcgaatcgacagatgctcgtcgttgtttcccatgttgggacgagcctgcccataaagccacatttgaaataagccttactgtacctaagaacttagttgccttatcaaatatgccagttaaaaatagtcaacctgaaggtgatctcattaaatatgactttgaaaaaacccccattatgtcaacgtacttagtagcagctgttatcggagaatacgattatgttgaggacaagtcgagtgacggtgtactcgttagggtgtatactccaaaaggaaaaaaagaacaaggactgttcgctcttgaagtagccacaaaagtattgccttattacaaagagtattttaatatagcttatccactacctaagattgatttgatcgctattgcggacttctgcgctggtgctatggaaaattggggccttgtgacttacagagaaacctgtcttctcgtagatcctaaaaacacttcggctgttagcaaacaatggattgcgctagtcgtaggtcacgaacttgctcatcagtggttcggaaatcttgtgactatggaatggtggacccatctgtggttaaatgaaggttacgcttcatttgtagaatttctctgcgtcaactacctcttccccgagtacgatatctggactcaatttgttaatgattcgtacatcaaagctctagaattagacagtttgaaaaattctcatcccatcgaagtacctgttggaaacccctccgaaattgacgaaatattcgatgacattagctacaacaaaggagcttctgttataagaatgttgcatcattatatcggagatgaggatttcaggaaaggcatgcatttgtacttaaccagacatcagtacaaaaatactttcacagaaaacttgtgggctgctttagaggaagccagtcaaaaaccagttggggacgttatgtctttttggaccaaacaaaaaggatttcccgttgttaaagttacacagcaaccggcaggtgacggtggtggtgttaaactaacgctctcgcaatctaaattcaccgcagatggatcgagtccagcggacgaagattatctgtggatgataccaatttccatatctacctccaaacatccttccaaagaagtagtttgcattgttctcactacgagaacggcagaaatcgttgtacctgaagttggaaaatcggattggattaaggttaatccaggagctattggcttctatcgaacccaatacaccccagaaatgttggagaagtttattcctgctattagggatagatctctaccgccattggataggttaggtttattagacgacttatttgctatggttaaagctggacatacaagtactgttgaagttttaaagcttcttaacgcatacgaagacgaacccgattacaacgtttggtgttcgattgtaaatgttctcggacgcttaggacaacttttgggccatacagaatatgaagcagactacaacaagttccaaaagagactcttgagcaaagtgtatagcagattgggatggacacaaaaatcaggcgaaacacatctcgataccctattaagagggttagtattaggtcgattggcgtggttagatcacgaacataccatatctgaggccaggaacatatttgatacccacgtcaaatctgagcaagtgctacctgccgatctgagaagcgcttgttataaaacaattttgagagctggtggtgaagctgaatacgacactttattgcagctgtataggtctagcgatctccacgaagaaaaggatagaattagcagagcatttggagccaccaaagatccgaaattgttaaagaaagttctggaatttgctatgtcggatgaagttagatctcaagacacagtatttgtaatagcttcggtgggattgaacagtactggaagagatatcgcttggcaattctttaaagacaactggcctcaaatcagggaacgattctacggttctcttcttacaagattagtcaagtatctgacagagaatttcgccagtgacgaaagagccaaagaagttgaagctttcttcgccgaacacaaacccccaggtacagagagaactgtacagcagtccatcgagacaattaatttgaacacaacttggctaaatagagactcggctgccattaaagagtacctcagaactatataa

SEQ ID NO: 129 - DNA, 2301 bp, Diabrotica virgifera virgifera
atgtccaaagactctcgatatacgccagtgaatacaaatccagataaaaatccaacatggtggaagcgacgtacaagtatggagaggtgtctaaccttatcaacgggtattgcccttcttattggaatctccttactcatagcacttgccacagtattatatagcagagatcaacatgttagtaataaaccgtacacagcccaaccactacaaggaaaaatagtcacaattacatcccaagatcacgaagatgaaaaagtatgtttaagtccaggatgcattcatactgcatcacgtgtattggaatatatggatgaatcggttgacccttgcgatgatttttatcaatttacctgtggtaattttatcaagaagacaaatattcctgatgataaatcctcagtaacttcatttactctaattggtgatgaacttcaagagcaattgagaactatgatcgaggaaccgatccaagaagatgaaccaaaaccattcaagcttactaagaaattatacaaggcatgtatgaataaaactttgattgaagaggatggaatgaccactattacagaagtgctgaaggagttgggtggttggcctgttttagaaggagattcttggaatgaagatgattttgattggaaaaactctgtatataaatttcgaaaagtgggttatggcgtggattattttattgatttttctgttgttggagatgtcaagaattctaccaagagagtaattgatttggatcaagcatctttgggtctgagacgggaattcttaatcaagggactcgatgaaaaaatagtcaaggcctattacgattatatggttgatttagcagtactgtttggagctgagcgagagagagcagctaaagaattaagagcttctctagagtttgaaattcaattagctaagatatctctgccaagtgaaaaacgccgtaacatgacagccttatataatccaatgacgattgaacagttgcaagaaaaatttagaagtattccttgggtagaatacattaataaccttctagccccggatacaaccgtagaatctggtgaaattgtagttgtaaacgttccgtcgtaccttaaagctttcgaaactctagttagcaagacgccaaagagggtacaggctaattatgtaatgtggagagctgcatcaaactcagtatcatatttaacagaacgtttaagaaagaggcaattagactacacagcagtaattactggcaaaacagaacgagaacccagatggaaagagtgcattgatattacttcagtcagtttatccattgcatctggagctttgtacgtaagaaaatactttaacgaacaagcaagacaaaacgctattgatatggtaaaagatatcagagctgagtttcaagatattttgaaagttgttgattggatggacgaagaaacaagagaaaatgcattggaaaaagctaaatctatgacgtcgcacattgcctatcctgacgaattactcgatgatgaaaaacttaaagaattttatgatggtctggaaatggaccgtaaccaatactttaaatcaattttaaatctaactctgttcggaacaagattttcattcaaaagattgagacaacctgtaaataaaactgactggattactcacggaagacctgctattgttaacgcattttattcatctattgaaaatagcatacagttccctgctggtattctccaaggagtattctttaacgctgatcgtcccagatatatgaactatggtgcaattggctttgttattggacatgagatcacacatggttttgacgatcaaggtagacaatttgataaagtgggaaatttagtagattggtggcaagaaacaacgaaaaaacgatttgtggaaaaagctcaatgtattattgatcaatatgctaattacactgttccagaactaaatttaaatctgaatggcattaacactcaaggcgaaaacatagcggacaatggcggcatcaaagaagcatacttggcttacgatcgatgggtaaaacggaatggggaggaatactttttacctggtctcaactacactggtagacaaatgttctggatgtctgccgcaagcatttggtgttcggtaacaagaaaagaagaacttcagcaaatgataatcaccgacgagcatgtacctgataaatttagagttaatgggcctctcgctaatatgaagtattttgcggacgatttcaattgccggaaaggagctccgatgaaccctgaacataagtgccaagtttggtag

SEQ ID NO: 130 - DNA, 2787 bp, Diabrotica virgifera virgifera
atgactccactttcgtttctctctgtcctactagtttttctgcctttcgtttaccttcaagaatatcgtttaccaaaaactgtagtaccgtcacattatgcattgtccttcacgtttaatcgacaagtatttgctggaactatattcgagttcagtggatcgacagttattacaataaaaacgtcagaaagtgtagccaacattcaattgcatgcagatccgtcgtttcttcgtattggagccataagtttggaccagggtggcgaaattgatagctacaatgtggatgccgttactcaaattttaacaataactactaaagcagctctaaatcccgaaatcgaatataagctaaccataacctatagagcggacataagtaccaaagaaatgataggactttatcaaagtacctatcaagatgccaatcaagctacaaattatctagtggctacccaactggagcctacctacgctagaagagtctttccttgttttgatgagccgtcgtttaaagcaacttttcaagtcagtttcacccttggacctaatatcaccccaaggacaaatactaagcttgaatcatccaatcagatgacaccaagcatccttcaatatacctttgtaactactccagtcatgtcaacatacttgctgtcttttgttatatcaaatttagactgcaccgatgctgctaccatcaacggagtacagaattctgtttgctctagaccaggtactgagaacttaagagactgggctgtgaatattgctccaaaaattcttgcaagtcttggagagtacactaagttggattataacttggcgatgaacaaaatggattatgtagcgattcctgatttttctgttgaagctatggagaattgggggctttccacttatagggaacaaagtttactatacgatcctgaacattcaaccaatatcgacaaacaaaatgtagctacactcctcgcccatgaaatagctcatcagtggtttggcaacctggtaacttgcaactggtggtcagaaacattcttaaatgaagcttttggtgactactttgagtactttgctgcacatatgatcctacctgcttggcaactggacaaacagcatgttgtcaacaacgtccagaaggcactgagggccgatgaagggaacctaccagcgctccagagcactgtatcctctcctgtagagattttaggaagatttaatgtggtttcctatactaaaggaagcagtattctgcgaatggtagaacatattttgggttcagaaaacttcaaggatgggatataccattatctcaacagtcacaaatttaaaagtactacgtcaagcgatttgtggagaggtttccaagcgtatttagacaattcctattccattttaccaaactatctaaatttgggagccgtgatgaacaattgggtagtacaatcaggatttccgttagtgacggttacagttagcgagggaaatgtgcagatagaacaaagaagatttggtgataacggaactgacgacaattctaaatggtatgttcctattaccttcatcacttctggctcatctggagttccttctactcgtccaagctattggttaactcctgaaaataacgtagcctttcaattaccgcaaggtgccgagtggattattgttaacaatcttcaaacaggatactatagggttaattacgataccgctacctggaataagattgaagaagtattcaaaagcaataatttcggcagcatcaatgaaattactagagcacagatagtagatgacttgttcagtcttgccaacataggagaaataagttattcgagggttttgaagtttttggagttcctgtctgaagaaacatcgtattttacatggacgtcagcttttaatggttttcaatttctctttaacagacttcagaatcagtccaatttaaccgagactgttacgagtaatgttttgtctctcatggataaattgtacaaatctacaccatttgatgttatagatgacgataaccaagttttcactcttaaaaaaatgttgacacttagttgggcttgccaattgggccatcctgagtgtctcgtcatgtcacgtgcttcattcttatcctataaattgagtggagtaaaaccacaaaagaacttgcgcagtacaatatattgtacagctctgcagacaagctcagaaagagaaaattgggactttttgcttaaggttcataacgaagccgaccttgactctgagcgccctcttttgctcaaatctttagcttgtacacaaaataaagagcttctacaagaattgttgttgttgactattgctgacgattctccgattgctcgagaagattgtataacagttctgggtagtgttgctgctaattcaaacggagctgaacaagcgtttgattttgtaattaataactacgataatataactcaaaggtaccaagctacgaatacaatagcgaatattttggaaataatcggtggtgctattacaactgaagaacaagtggacaagttccgatctttcatcaatggtggtcaattaccaaaagactatgttaacgatggcgaaagagcactggaaattgcacagaaaaaccttaactggtcggaaaaacacgaaaaagatctaattaatcattactatccagagtcaaaggaaccagacgaacctcaaccatatacaggagagggagtttctataggttcgaatggtttgatcattggttttatagtatcatatttattattg

SEQ ID NO: 131 - DNA, 2604 bp, Diabrotica virgifera virgifera
atggaaaaaaacaattgcgaaaaaaattgcaatagagaccaattggcaaagtacagattgccggacactgtcaagcctttgctatatgatctctatctttatccagatctaaagaccggactatttacaggaaaagtaaatatctctttggagattttaaaagaaacagagagcgtgagcttacactcaaaggggctcaatattgcaaatgtgaaggttgcctcccagccaggaatatttaccatagaaaagacctacgatttactcaacatcaaaagacaagataattctaaatttatacctggatttgataatgttgagattgagtttaatggtgatatgaaaaacagaattgtggggttatataccagcagctatacaacatcatcaggagagaaaaggcaaattgcaaccagtaagtttgagccaacattcgccagacaagcctacccctgctttgacgagcccaatttaaaagccaaatacaaagtccatttattgaaaccaaaggatagctcctacatagctctatctaattatcctgtagagaatgtaacagattacgataacgaccaccaactagtcactttcgatgaaactgtatcaatgtcgacgtacctgtcatgttttatcgtttccgattttacacataccgaaacatccttcaacaacagcggaaaaattgtaccccttaaagtgttcgctagccctgaaaatttggataaaacaagatatgcaggagaagtaggaaaaaaagtcattgaatattatgtacagtattttcaaatgccttatcctctgccaaaattggatctggttgctattcctgattttgtgtcaggcgctatggaacactggggtcttgtcactttcagggaaacggcccttctgtatacaaatacaacgcattcaagtctcaataaacaaagagtggcaactgtagtggcccatgaattagctcatagttggtttggaaatctagtcacgatgaattggtggaatgatttgtggttaaatgaaggatttgcctcttacattgaatacaaaggagtattagcagcagaacctacttggggcatgcttgaacaatttattataaccgatttgcatcctgtattatcatttgatgccaaactaagttcacatcctattgttaaacatgttgtaacgccagatcaaattactgagatatttgatgttatctcttacaataagggagcatctatcttgcgaatgctggaagccacagtaggcgacgaagttttccaaaatggcgtcaaaaactacttaaataggtacgcatttggcaacgccgtcacgaaagacttattaagcgaattgcagcttctagtcggaaataaattggatgtcacagagatgatggacacgtttacacttcagatgggttatcctatattagatgttgccatatcgggcgatacttacactttgactcagaagaggtttttaaaggatcctaatgctgtttataatgttaacgaaaccaagtataagtataggtggtctgtaccagtgacttacgttacaaatttgggcaagtctagcgaattcatactttttaaatacagtgataatcaggttaccataaagaaaccagctggagcaacatggctgaaattcaataccgaccaaataggttactaccgagtcaactatccactcgatgaatggcaaaatataataaacaactataaattgtttagtaccggagacaggacccatcttctagaagaaactttctgtatagccgaagccaatcaattaaattatacaattccactggaactgactaaaaagttgaaagacgaaatcgattttactccgtggagtgtagctacatccaatttaaaagatattcttgctaggcttagaggcgctaagtcagatatgatctcggcatacaaggaatatattacaaagattgtttcacctgcttacaataaatttacttggacagaagatgcaagtgataagcaccttgaaaagttagcaagactcagagtacttagtctagcctgttcagctgatcataaggaagcattggaagaagcgcgctcaaaatttaatacctggatagaaactaaacagccaatatcaccaaatttacgaagtcttgtatatgtttacggaattaagaatgcttctgaaagtgattgggataatatgttgcaagtatatatgaatgaaactgatgcttcagagaaagtaaaacttatggatggtttgtcaagtgtggacaatgttaatttgctgaaaaaattgttggatttggttaaaaacgaatcagtggtaagaagtcaagactacctcatagttttaggaactatttcaatcaatcccaaaggaactgacctggtttgggattttgttaggtcaaattgggactatttagtaggaaggtacaccttaaatgagagaaacttgggcaatctgatacctagaattaccaacaacttctatactcctgataggttacaagagattgaagacttctttaagaaatatccagaagctggagctggggcaattaaaagaaaagaggctttagaaaccgtacggaataatattctatgggtgtcgaat

SEQ ID NO: 132 - DNA, 1674 bp, Diabrotica virgifera virgifera
gcaacgtacatggctagcttggccctcgaagatctatttccacaatggaattctctagaggaagaagatgctgataatatattggacgttttctcgtttgatgcactaaggacttctcatccggtatcagtaccaatcggaaaccccaaagaaatcgatgaaattttcgacacaatttcctacaaaaagggatcatccctgataagaatgatgactctcttccttggagaagagatattgagaaaaggagtcagcaactacctcaaaaaacacaaatacggaaatgccgaacaggatgatttatgggaggctctaactaaggaggctcacagtcaaaatgtgcttcctaaaaatttaaccgttaaacttatcatggacacgtggactgtacagacggggtatccggttattaatgtaatgagggattactcaaagaaatcggcttctatttctcagcatcgccaccttagagacataatatacccgaaagacgcttctaaaccatgttggtgggtacctttaagttattcaaccaaatcaaaccccaattttaattctacaactccaaaacattggctttcttgtccagaacatagtcaaactatagaagatttgggcgatgaaaacgattgggtaattttcaacaataaaatggcaggaatatacaaggtaaactacgatgagagaaactggaacatgatcacgaagttcttgcagggtcccgactttcaaacgatcccaactttaaacagagttcagatcattagcgatgctgcagatttagcttacattggaagtctcaaatacgagatctttttcgagatgttgaagtatcttaagaaggaaactgagtatatgccttggaaagctgctatagataagactgatgtcatcaccaagcatttgaagaagtctgcatcgtacggaaaatacaaggaatacatgagacatttgttaacacccatttatgaaaaattcggaggattcgaagtgaccaccgatccagaaaaattggattatatcaaattgcaagcattgattgtcagcagatcctgtgcatttgaagttgcaaattgcgtatcacaagcaaaatctctctttaataaacttaaagaaaaacaatctgataatgtaattcccaaagatctaagaagtgccgtttactgtaccgttttaaaacatggcggcgaggcagaatgggacttcctctggaacaagtaccaaaactctaacgtagcaacagaaaaaagtaccattttaaccaatctcggttgtaccgaagaaatatggatgcttgcaagatacttagattggtcattgaatgacacccagatcagaagacaagacagtagttcagtattcgcctccgtttcaagaaataatgtgggatacttcattgcgaagaattacttctataataatatcgataaagtctataaacatttactgacaaataaaaagacactgtcgagatatttatcagctctgtcaaaccaaattaccgatgccaaagacgaaaaagaattcgaacgcttcatcaaaggcaacaagaagaccttcgccgaagtcaaaaagggcgtcgaacaatccctagaaaccgtcaaaatcaacatacaatggcagcacacgcacgctgaggaaatagctgacatcttgaacaaatattccaaataa

SEQ ID NO: 133 - DNA, 2037 bp, Diabrotica virgifera virgifera
atgtggtctagtaaaatcagcagaacttccttcacgactctcgatatttaccgaagaataactcgaggagtaactaatctagcaaaatcgagacaagcatctacctccgatatacatttgtttaaagttggagaaaagtatcacggattcgaagcaaaacgcatagcaagtattcccgagctgaaaacgaccgccttgtacttattacacgagaagaccaaagcccagtacctgcatttatataggaatgattcgaataatgtattttctgtcaatttacgaacgacaccgatgaatagcactggtttgccgcacattttagagcacaccgtgttatgtggatcggaaatatttcctgtacgtgatccgttttttaaaatgttaaacagatctttagctacgtttatgaatgctatgactggacctgattatacaatgtatcccttcagcacgttaaactatacggattacctaaacttgcaaaaagtttatctagatgcagtatttagaccacaactaaaggaactcgattttatgcaggagggttggagactcgaaaacgttgatccgaatgatgtaaacagcgatattattatcaaaggaattgtttacaacgagatgaagggagtttttgcttcaaacgactcgatacttggccaaaaactacaaaatcttattctaccttctcatacctacggagttatatccggtggagacccacaagaaataccaaaccttacttggaacgatttgaagaacttccacaagcaacattaccatccgagtaatagcagacttttttcttacggaaactttccactattaccttcattggaatacattgataaagaatatttaagcaaatatgcatactcacccccgacacatacagtagtgcccaaggagaagagatgggaggccgcaaaaagagaacacataaaatgccgttatgatgttttgggcgcccctttcgaaaagcagaatacaatttcaatatcggtgttagcttctgacactacggacgcttatcaaacattagtagttgacttcttgacaaatctattgataaaaggaccgaacgctcctttttatcaaagtatgatcgagcctaatatttctgggggattcactgctagcactggctttgataatcaacctcgagatggaatggttacaataggtttacagtctgttaaaaaagaagattttgataaagtgatatctattttcgaacaaacagtggataaggttatagaaaaaggatttgaaccccatcacattgaaatggttttgcacagttacgaactgtccttggctcacgaaagtagcaactatggtttaggtctcttatttggtatttctacggcttggaatcacactgaaaacataatagaacatttacaaagtaggaaatggatagacagattgaaacaagacattaaaacaaatccgaattttttgcaagacaacgttagaaagattttcaaagataaccaacataaacttatattgacaatgtctgcagacaaagattttgaagctgaattagccaaagcagaaaaccagctgattaagcaaaagaccaaaggtttgtctagtaaagataagaaagttattcatgaaaaagcattagaactacaaaaacaacagatggaacctacaagaactgaacttttaccaactttgttaattgacgatattagttctgatgtagaaaaagttgatatggaaaaagtctctttgaacaacgtacccacccaaatcaacaaagtgaattcaaatggaatagtgtattttaaagcaatgctcaacacaaattatttgtctccagatcaacagatgcttctacctttattctgcttcactattagtaaattaggtactgacaagcttaactacaaagagttcgatagtctgataaatagaaagacaggtggtttgacattgaacagtcatattggagaaagtttatacagcttgcacacttaccaaccgagtctacttcttagcagttacgctttagaaagaaacgttgaa

SEQ ID NO: 134 - DNA, 2088 bp, Diabrotica virgifera virgifera
atgtttaagtattattttgtagtgttgtgtttttcgttatattttgctgttggatgttttgaatgtttaacctatcggctcaatccatcagaagctgtgccaataacctacgaaatcgtaatcaaacctgatttagataatgatgtatttcatggagaagtcatcatttatgtagtgactaaaataagcttaaatggtattacattacatagcgatgaacttaatataactgatgtttatattaaccaaataaaaggttgttatgtagaagaaacagaagaaagaataacagtcaaatataataatggtcctttacaaccgggagagcacacactgttgtttaagtattctggaaaaattcgaccctcacatggtctaataaaagctttatatgaatataaagatactaaagaatacgtttatgtcacggatttggaaccgaacaaggccaggcgagtatttccctgctttgacgaacctcaatttaaagctaagtaccatattaagctggtatcaccaaacgaaacttatgcggctatttcaaatatgcctgaaattaccaaattccgcacctcgtatggaattgttcatgaatttgcagcctcggttccgatgtcaacatacctggtatcttttgcttttactaattttccttactacagtgaaaatttcgaataccaaggaagacagattccaataagaatattcacggtcaacgcaagtaaagaaaataacgagtttgctatgcaatgtgtcaaaactgcattgtctttttattcggattatacggacattagctacccactacccaaattagatatgattgaatacaaacgagaggaaagtgcagctacagaaaattggggattaattacttttaggcagggtctgcttactacgccgttacgtatttacagcaaatttcaaataaaactggtggcgttccacgaattaagtcatttttggtttggaaatttggtaacgaacgcatggtggaatgatatctggctacaagaaggatttgcaacttatatgagctataaattatcagcacaggataataataatacgcagcttgatgagatgaaatcttataactttaacgaattctttgaaacagaaatttatgagaagagccagccaatcgttcaatatttaccagacccaagtaaaattgctgatgtttttaacggccttgtgtacgaaaaggcttcggcgattcttttaatgttggaggacgaaattggtcaggaaaaattcaaagaaataatcaggacatttctaaagaaatacgcatatcatacagctactacaaatgattttattacagtcgtagaagaagtggtgtcagacatacctctaagaacgtttttggagagttatttgtaccaaaataaatttccagttctcaacgtcgatattgtaaataactcgacgtatgttataacacaacaaatttgcgagacggttcaacaagaaccaattagtgctactaaatggacgattccaattagttaccaaactgattattctaatgattcaaaacatgtatggtttcacagagaaatggaagaattaagacttgaggaagctgatgcgaaatggatcatttttaatcccgaagggaaccaaatgtataaagctatatggtcaactaatatatggaacaaaatcatcagcaactttgatttaatggattattctactacagacacggttatttcggacgcctattattcattccgattcaataaaatcaaatgtgaaatagtaatacacctcatggaacaattaaaaccagaacacaagagaaaatggatacttttctacgcattctacgatcaccttaaagaaaacctcttctgtcataaatatactgaagaagcgacacttttctggaaattcctgaagagaagattttctgaaacaaattatccaaaaacgcctaaattaagaaaacctgaatcatgcgataatcaatacataattcaaaatgaagactaccgaaaaaatttagaccagtgcgcgacatggattagagaaaatctaaaagagaaagattcgaacgcaatcaagacaattctttga

SEQ ID NO: 135 - DNA, 1833 bp, Diabrotica virgifera virgifera
atggtaaaagcaggcctaagtccttgtgatcctagttcattttctagaccagatcaagtcattgttactgaattatttttgaatttggatgttaattttgaatcaaaaacattacatggacatgctattctttctataaataaaattgatgaaacagctacagaactggtacttgacacatttaaattgaatataacgtcgatatttgacgctgataaaaattgtacagaaaaattagaatatacattatcagatcacttagaagattttggatcaaaattaacaattcagttgccccaaaaagaagttaaaaaaattcatatcgagtatgaaactgcccccgacgctagtggtcttcaatggctccagccacaaacaaccgcaggaaaaatacacccatttttatttagccaatttcaaccaacacatgcaagatctgtgataccttgccaagatactccagctgttaaacatccttacagagctacaatttctgccccaaaggaattggaagtgttaatgtcggctatcaatgaaggatccaaggtgattggcgacaagaagcaatattctttttaccagcagattccagtgccttcttaccttatagcccttgctgtaggtgctcttgaatctaggcgtttgggacccagatcacacgtttgggcagaaaaagaactgatcgaggagagtgcctatgaatttgctgaaacagaacatcaacttaagactgctgaagatatttgtggaccatatgtgtggggtatatatgatcttctggtcttacctcccagttttccatatggaggaatggaaaacccttgtttaacttttgttacgcccactttattggctggcgatagatctttagctaatgtaatagctcatgaaatatcacacagttggacaggaaatctggtaacgaacaaaaccttcgagcatttctggttaaatgagggttttacaatgttggttgagaggaaaattattagtagattggtatcaccacaaatgcaagactttgacgcctacacgggcataagtgatttaaaagaagctatagaagtgttgggcgctgatagtcctttaactaatcttatagtagatttaaaaggagtccatccagatgaagcattttcaacagtcccatatgaaaagggtcaaacattccttaggtatttagaaaaaactgttggtggtccagataagttcgagccgtttttaagatcctactttgataccttcaaatacaaatctattgacaccacagattttaaaaacttttttgaaaattactttgaaagtgaacctgaaatcaaaaatatcgattgggacaaatggttgcataccccaggaatgcctttaaccattccagattacgatacttccttggctgaagcctgtgatcaactcttggagaaattttacaattggacgggagaaggttctttgccaatatctgctgaagacaagcaacaacttataccagaacaactaatatactttttgcagaaactgtcagaagctgagtcgcaaccaattccaaaacttgttgctttaaatgaactgtttggttttgatggtgttaaaaattcagaaattaaattccgttggctgaaaactggcattaaggccaaatgggaagtacaaattcaaaacgctttagattgggtgaatgtggttggtagaatgaaatttgtaaaacctttatatagagaattattccaatgggaggttagtcgaaatagagctattgaaaattttaaatctaatagacataatatgatgcatgtttgtgcaactactcttgctaaagaattaaaaattgaatag

SEQ ID NO: 136 - DNA, 1892 bp, Diabrotica virgifera virgifera
gaacttaaacaagagtattatagattagtaacagcccaagtcaaatcatcggaacagtttgaagtcgctgaaaagaagaaagtggtaagagctattagcttggcagaaagtagcacaggctctgaccataacatagaggctacaaaagaagataatgaagacgattttaatgaaaataaagacgtttccgtttttgaaatattaaagatgaatgctccagaatggccttacattttatttgctggtcttggatcaattgttgttggttgtggaatgcccgtttttgcagtcttgtttggtagcattttggggacattagcaaatggtgatcctgactttgtaagatctgaaaccaacaaatattgcttatattttgtgctgggaggactcataactatggtatcagtatttactcagatgtacctgttaggaattgctggtgaaaaaatgacagaaagagttaggagtcgattattcaaggcaatgatataccaggaaataggcttctttgacaagaaaacaaatggggttggagcgctttgtgccaaattgtcttctgatgcttctaatattcaaggggcaacaggaattcgggttggaaccattcttcaatcaatagccacattttgcttagcaattggtctttccatgtattatgaatggaaattgggtttagttacagcagctttcacacctgttattttgatcgctatgttctttgaaagaagaaacaccagaggtggaaacgattcaagagattccgcactacaaaaatcaacaaggactgcagtagaagccgttgggaatatacgaacagttgcctccttaggcttagaagaaagttccagcagctatatgaatctgagctcatgccacattataaatcttcgttaaaaacagttcactggagagcaatcgtgtttggtctttccagaagtttgttgttctttgcttatgctaccgcaatgtactacggcggatttttgataagggatggattgccatacgatagagtatttaaggtatctcaagcacaaattatgggtacagtttcaattgccaactcactggcattttctccaaactttgctaagggtgttgcagcagcaaaaaaagttaaaagcttcctttcaagaattccacttattcgtgatttaccttcttcacgacaaatggttaaggcaagtggcaacttcagtttttcagaaatcgaatttacgtatccaacacgacccaacgtactaattttaaaaggacttaatttggacattctaaatggaaaaactgtagctctagtgggagaaagtggttgcggaaaatctacgataattcaactcatcgagagattttacgatcctagatctggtgaagtaaaaatggatggtgtagatttaaaagatatatcactagattcgttgaggtcgcatatgggtatcgtatcacaagaaccaaatctgttcaataagtctattgctgaaaatattgcttatggagataattcaagggaggtttctatggatgagataattaaagctgctaaaaatgccaatattcataattttataactggattaccgaagggatatgaaacaaaactaggagaaaaggctgttcagttgtctggtggacaaaaacaaagaattgctattgccagagcattagtaagaaatccaaaagttttacttcttgatgaagccacatctgcactggacactgaaagtgaaaaggttgtccaagaagcattaaatgaagcgaaaaaaggaaggacgtgtattacgattgcccacagattaacaaccatacaagatgcagacttgatatgcgtagtcgcaaatggtgtaattgctgaatctggaagccatcaagaacttctgcaaaaggagggactgtac

SEQ ID NO: 137 - DNA, 1752 bp, Diabrotica virgifera virgifera
ctgtttggcatgaagtcggtaggcgttgggataggcgttattttaactacctatatatcaacggtcctttttatttacagcgcatctagacagatcttcaaaatcagaaaagcttttcttgagaaaacgcttaatcaagatattgcgtggtttgaccagaatcgtactggagactttgcaagtacattcacacaaaacatttcaaaattagaagagggaattggtgagaaaattggaacttttctattttttgagtcaacctttgtagcaggatgtgttttgggtctagttaaaggatggaaattagcattggtgtgcatggtatcccttcctttatcgactacaattatgacaataatatcatggatatctacaaaattttcagcgcaagaaatggaatcatacggagaagctggtaccatcgctgaagaggtcttcaccgcaatcaaaactgttgttgcttttgatggacaagacaaagaaattgaaagatataataaacacctcgttgatgccaaaaagaataacttaaaacgtagcttttttactgctgtaagtaatggatgcttatggtttttcgtatacgcgtgctacgctttgtcgttttggtatggagtaacattaatactgaatgacagacatcttccagaacacgaacaagtttatacaccggcaaatatggtatctgtgttcttttcaacgttaatagctacttggaattttggattaggagctccactactggagacttttggaacagccaaaggggcagcacaaaaaatatttttcgtattagatagcaaacctgttatcagaaaatttgcaaacagtggaattgtaataaatgatgccgctttggaagtaacatttgaagatgtgcattttagttatccttcaagatcagatgtaaagattcttagaggtataaatcttacaataagtaaaggtgagacagttgcattagttggaaaatctggatgtggtaaatctacctgtattcaattacttcagaggttttacgatccagatatgggtcaaataaagataaatggtatagatattaagcagctaaatttagactggcttaaacaaaagatttccgttgtaagtcaagagccagatttattttccactaccatcgccgaaaacataagatatggaaaactaaatgctactcaacaagaaatagagaatgcagcgaagaaagctgacatccacacatttatacagactttgccgcggggttaccaaacggttctaggagaacgaggaactcagttatctggtggccagaaacaaaagatagccatagctagagctctagtacgaactcccgagtttctacttctagatgaagcgacttcagctctcgatacgacaagtgaggcagaaatacaagaggctttagattcaatacgaggaacctgtacaataataatagttgcacatcggctatcaactatacgacaagcaagtaaaatcgtggtaatcaatgaaggaaaggttttagaaatgggcacacatactgaactaatggatatgaaaggagcttatcacaatctagtaatttctcaaggactaactgaaactttagaagaaaaaggtaatagacgacggagcaggaaattcagtgaagctaacaagtctataaatgaaaaagaagacgaagaacttgaagatacacagattaatcaaccagttgcgaagaacattttatggaaggttttaaaattaaacgcctcagaatggttt

SEQ ID NO: 138 - DNA, 1584 bp, Diabrotica virgifera virgifera
atggtgtctacgaaaaactttgtgattctgatcattgcgactgtggttcaccaaatccgtccagttatcaatataaaagaaggtcaaaatttctggaaacaacgaggttatctagaattagatgaagcaattaataagaaaattatcgatggtccagccaacaatgttattttgtttgtagctgatggtatggggatgacaacgatgactagctctagaatctacggaaaaggagaacaaggttctttggcgtgggaaaaattcaacaacatcggaatacttaagatttattcagcaaacaagttggtaccagattcttgtagcactgcaactgctctcttttgtggtgtaaaggccaaccataaaactgcaggtgtggatgccaccgtggacgttaatgactgtgatgcagcaatgaaggaagagtctcacttggaaagtataatgacgtgggcacaggcagcagaaaaatctacaggttttgttacgactactagagtaacccacgctacaccaagtgccctctatgctcatatacctaatcgcagttgggaatgtgaaagtaaaataccccagaattcaacaaaatgcaaagatattgccaagcaactcatccaagatatgcctggaaagaaaatacaagtaattatgggaggaggaaggcagtgtcttcaatcgtcagtgcccgattctccagcagatccagtggacacctggtcttgttatagtaaagatggaagggatcttataactgactggaaaaaggataaagaaaaaaatggatatacgtatcaggttgtaaataataacgaggaacttcagaatttagatctgcagaaagaatacactttgggagtattcgcaaatggacatctaaaatatgattacgaaagagacaaaggtcccaaaggaatgccttcattagcgaatatgacggaaaaagctatccaattgctacaaaataacaaaaatggttatgtgctgatggtagaaggcggcatgatcgaccaagctcaccatcgcggccacgcaagaaaagctttaggagaaacaatcggctttagcgacgcaatagaaagagctttggaattgacggatccttccgagacccttattattgtcacaagtgatcattctcattccatgatattaacgggatatccagacagaggacgaggagttctttcttataccaattccgcaatggacaatttaccatttacatctttgttgtatggtacaggtggacctaataattatcaatttgtattggataataacacagcgactcgtattgatccgtctaaaaacaatactggagattgggaatattctcaacaagcattggttcttacagatgaggtaactcatagtggagctgatgtattggtttttgcgagaggtcccatggctcacctattcaactcagttcatgaacaaacctatgtagcatatgttattgcatatgcaactaaaataggaccatatagtgattcaacgaatggatcagtaggtttttcagacttcaaatatatccatgtgataaccatatttcttatagtagctagttttgtgataggtgat

SEQ ID NO: 139 - DNA, 945 bp, Diabrotica virgifera virgifera
aaactaccagtgtcagttgttccaacacattataaaatacaccttttaccagatttgagcgattttacatttaaaggggaagtcagtattaatattgaggtaaaaacttctacgcatgaaattaaattacattcactagatttggagctgaattcaataactttaaaacatgaaggggaacaatatacacctatcgatacaaaattacacactgaggaagaaatggctgtgtttaaatttaagtcttcccttactccgggaaattatactttggatattgcatttagtggaaaattggaagataacatgaaaggattttatagaagtaaacatgtagatgaaaaaggagccgagttttattctgctgtttcccacttcgctccaacagatgcaaggcgctcttttccttgttgggatgagccagctattaaggctacatttgatgtcagcttgaccgtaccaaaacatctcctggcactttctaatatgtctattttaacttcaaagaataaaggagagttaattaagtacactttccatacgtcaccgaaaatgtctacatatttagtagcgtacgctgtgggagaattcgatttcgtggagaaaatatcttcagatggagtgttaataagagtatacacaccattaggtaagaaggaacagggagaatttgccttagatgttgcaacaaaggttttgccttactataagcaatattttgatatcgcttacccgctaccaaaattggacttgattgctgtgggtagcttaggatttagtgcaatggaaaattggggccttattacttatagagaaaatcgtgtattaattgatccccaaaactcatcaaattcaaccaagcagggagtggcgctggtcgttgcccatgagttagctcatcagtggtttggaaatttggtaactatgaagtggtggaccgattta

SEQ ID NO: 140 - DNA, 936 bp, Diabrotica virgifera virgifera
gtaaaccatgccaaaactattgccaacattatcaacggactttactctcccttaaatatttttatagctttagtaggagtagtgatatggaccgaaaacgatgaaattaatttctctcctaatggagatacgacgctcacgaattttctccattatcgaagagagaagcttattaagagtcatcccaacgacaatgctcaattattaacgaaatttaattttgatcatggagttgtgggaaaagcacttaaaggccccatttgtacttacgaattctccggtggggtgaacacggaccattcacctgttgtcggacttgttgctaccaccgtcgcacacgaaatgggccataatttcggtatggaacacgacacgaacgagtgcgaatgcccggacgaccgttgcataatggctccgagcagctctaccgtcgctccgaaacattggtcctcgtgcagtctcaactaccttctgcaagccttcacccacgggatggattactgcctaaaaaacaagcctaaagcgttattcgacagtcccgtttgtgggaacggattcgtagagccgggcgagcagtgcgattgcggcctggaggaacactgtgataattattgctgtaacgccactacgtgcatgttgcatagtaacgctagctgtgcgacaggagagtgctgtgatcttacgacttgcctaccaaaaggtgcgggaactctatgcagatcggctgactacgaatgcgatcttccggaatactgcacaggacagtccgaatactgccccgaagataattacaagctagacacagaagtctgcgatgacggtaaagctttctgttaccatggtttctgcagcaccagatccgaccagtgcaaactgctgtggggagagacggggaaatccagcgacgaccagtgctacatgatgaacaccaaaggc

SEQ ID NO: 141 - DNA, 852 bp, Diabrotica virgifera virgifera
gctcatgagattggacataattttggttcaccgcatgactaccctccagaatgccgtcctgggggccccaatggtaactacattatgttcgcctccgccaccagcggtgatcgacccaacaacagcaaattttccagctgtagtgtcggcaatatcagcaacgttctagacgcgatcgaagagaagaagaaaagaaattgtttcactgcttccgctggtgccttctgcggtaataaaattgtggaagccggagaggaatgcgattgcgggtatgatgataaagaatgcaacgaccaatgttgctaccctagagttatcagtgtaagggataaggaacttaatagatcagccgttgggtgtacgagacgtgctggcactgaatgcagtcctagccaaggtccatgctgcagcggcgaatgcaagtttatatcttcgtatcggcaggaagtgtgcaaaatggaatccgattgttcccgatcgtcgaaatgtaacggttccagcgcagaatgccccgtgcctactcctcgcgcagataagactcggtgcaacaatggaacccaattgtgcatcaagggagaatgctccggctcgatctgcttagaatggaatttagaagcttgttctttgacaacacaagatcatcccaatatcgataagagaaagttgtgtgagttggcttgtcaaaatggcactgatatttgcagaagtaccagtgagtttgccgatagagtaggacttcctcctggaggcatcagtttaagaccgggttctccttgtgataatttccagggatattgcgacgtatttcttaaatgtgcaccagttcaggaacctatacttcgtctaacctaa

SEQ ID NO: 142 - DNA, 905 bp, Diabrotica virgifera virgifera
ccattggatcatttaaatctaaatcaagcaggttactatagagttaattacgatgacgtttgtggactagaatcattaatacattacatggacaagataaaaacaaaatacctgtgttaaatagagcacaactcatcgacgacatattttctctagctagagctggcaaagtcgattataagaaggcttttgaactactggattatcttaagtatgaaactgagtattatccttgggcctcagctttaagaacaacatcgcacatactagaacacgttaatgataaaacaaaagtgctactaaagtcaaaactcttaacactaataaatgcagcttttccatctgttactgaaataaaaagctccaaacacgtagatattttaaaggaacatttgatattgcattggaaatgttttctagatgataataactgcttgaatagtgccaaagtaaaatttgaggaattcaaaaattcaaatagtttccagaacaacaacgagagggatataggcctatcctttggagtacgcactagtaataatgtcttttatgattttaacttcctaatgactcactacgaacaattaaaatcgagggtagaacaggaatctatattaagatctttgggctgttttgtcgacgctacgattctggaaaattatctaaaggaaattgtatcagaaaaatcacctattgtatcttacgatgcactgaaagttttcgaatcagtgttgtcacataagcaaggtgtagaagcagctttaaaatttttagaagtaaccaaatcaatcattattaataagtatagtaaaatattgagtttgacggattttattattttattagaaaataaaattacaacgcaagaacaatatgagcagctgaaaaatattgtaactaataat

SEQ ID NO: 143 - DNA, 780 bp, Diabrotica virgifera virgifera
atggctcgtgtcgtagccttatttttaatatttgtgcatgctaccaattgctatcgacttccaaaagatgttccagagaactacaaattagaaatcatttccaacttaggagcaccaaaagatagttttaattttgatggaaaagtatggataacagtaacatgcactcatcccacgcaaaatataactctacattccaaacacttggacatcaaagatgatgacgttatcctgaaagacatcacaagtaacgactctaagaccgttaaaatatccaacgttgaatttaaagaagagttcgagtttttaattttaaatttagaggaagatttgaataccgatcacaaatatgaaatttatattgggttttctggtaaaatggacgacggacttgcaggattttatagaagcagttattacgataagaaagacaaggaaaagaaatggttgggtgttacacaatttgagcccatttctgcaagaatggcgttcccttgtttcgatgaacctgagatgaaagctacctttgacataagtatcggaagaaaagaaggctacacagtaatcagtaatatgcctgtgcttaggactgaaccattgaaagaaaaagacggctggttttgggatcgtttcgacacctcagtaccaatgtcaacgtatctagttgcttgggttgtatcagacttcgactataaatctggaaaattggtagaaaacaacaacgttacctttaggatctgggccagaaaagatgcaataaatcaagtagatttcgctaca

SEQ ID NO: 144 - DNA, 882 bp, Diabrotica virgifera virgifera
tggggaaacaccgaaccattggactacgagcgttcacacaatcatatcttgtcagtcatcgcgtatgattgcggtatgcgacaaagtttcccggcccttgtgacgatcaaggtcaacagagtatgcagactcggatggagaggattaccggaaagggtggactatgctcctatgactggaaaacaggaattgttcccatctgctaatttagaattgtgcgatgtaccttgcactattagagaattgaggactagagtcgatctagctacaagacacatcggaaaaggttgcgacagggacacttactcggttcagtcacaaaggaaattatgtggcgcttctccctctgccatcgatcttctgccaaatcccggagtaggtgctgaatggacaaaaccactcatttcggacgagggtcatgagagcgatcagatgtttgagtttgacggtgccactactgcggtaacaatcccaacatctgtactagagcaccagttgccaactacatttaccatatccacatggatgagacacggacaacatcctacccaggacaaacacttgaaagagcacattttctgcactgctgatgatcacaaaatgaatagacaccactatgctctcttcgtccgtaactgtagattgatccttctcttaaggcgagatttctcagaaggagacctcaacatctttaggcctgctgaatggagatggaagatttcacaagtttgcgacgaccaatggcatcatttcgctatcaacgtccgtttccctgacattcaactctatattgatggacagttgttcagagccgaaaagaagaatcctgaagtaatcgacgattggcctcttcaccccaccaaaggaatcaatactactctt

SEQ ID NO: 145 - DNA, 789 bp, Diabrotica virgifera virgifera
gaagaactgagagaaatcattagcaactatgaatactctggattatacgacaatttcctactcaaacttgtaacgccaatgtacaacgaactaggaacggacactagagtttttgatacccaaaatgaaaaattgttacggttgcatatagttatctcggcgtgtaaattgagatacggtaaatgtattacttgggcaaggaatatattctatcaatggatgaaagaagaggatcctgatgcagagaatccaattccagttgactatcggttcatagcgcaatgtgctgctattaaatctggtgggcctgttgagtgggatttcctttggaatcgaacacgatatgcgaatatagcgccggtggatctgcaaactgcataccaaagtttagggtgtacgtatgatccttggttgataaatagatatttggagtattccttatctggcaacgttagcttggaatatgtgccctacgtctggcaatccataaaccatcctgtgggagttagaactggtttccaatttctaaggttaaattggaacttaatttataaaacctacgaggaggtttatttagtttttagtacgattttccatgacttccttggacaattctccactgaagctgacctagaagatctgacaacgttttataaaatccatcaaaccgacctgaaaaccatctctacaattctgcaaagtacagttgacagaatcaaagttcgcattaactggaaaacaaagcacttggattcagtagtcaattggttaaagagaaacagatattga

SEQ ID NO: 146 - DNA, 672 bp, Diabrotica virgifera virgifera
atgttcagtgattgtgttgctgtgttattgttgcttctagtcctaccttttattgaaagtgctgaacgactgaacgaatacattcgtcactatgagacccttgcctatgacaccgaagctgtccatagggctcacacacgagcgaaacggtccatcgcctcggacaattacgtccatgtggcattcaaggctcacggtcacgactttcgagtacggctgaaaagggaccttcacgtttttcaggacaaacttgaggtgcagggtccaacgggagaaccgctggacgtcgacacgtcgcacatatatcagggacacattttaggtgaacctgacagtgtagcctttggctcaatcattgaaggcgtttttgaagggaagctcatgttgccaagtaagggtgcattttacgtagaaaaggcccatcattattttcctcatacgacacatccgaacagaacattccatagtgttatctaccatgaagaccacgttgaggatccttatgctcacaaaagagaaggtcattctgctggctgtggaatcaatgacgatgtgatcgagtggatgaacaaaatccagtcgtcaggagaagacctgcccattaccccctctacggttgctttcaaaaaagccgtcaaacacaaaaaacatttaaaaaccaaaaaagacaag

SEQ ID NO: 147 - DNA, 465 bp, Diabrotica virgifera virgifera
atggaaatgaccaaagagaaatataatcccaatccacgggagaaagcgaatattttatcgactctattttttggatatacatatgatgtgtttaaaaagggcttatcgaaaactctagaagttgacgatttatataatccattaaagatcgatcgaagcaaaatattgggagatcatttacaaagcaactgggacaagcaactagaaaaagccaagaaaacaaactcaaaaccaagtttactgaaagccattcttatgacatattggttagagtatttgaagttaggaatattcgacataacaacagatttagtccttagactcatccaaccattaatgcttggaaagctgttggaccattttaaacctgaagcacaagtttcaaaaaatgaggcactcatgtatgcaggaatcatagtggctataaacgtattgaactttttgatcggaaatcagtatatggta

SEQ ID NO: 148 - DNA, 652 bp, Diabrotica virgifera virgifera
atgaggacgaaattagtgatttttctgtgtttggtattgtttgtgacaagtgtatacaatgaggatataccagtgaattctttattagatgagctgcatcctgctgcggaattcagccgacatacactcgtgaaacccaaactctaccatggaagagaaaaaagacaaatttcgtcgacgaaagagaagtcgggaaaacacactgatcatctacaaatcacgatggaagtggatggagaggacatgatattagatttgaccattaacaaagatttaattcctgaaggatttttccacaaacatcaaaaaaaacggagattacaaaattcatcaaccaacatttcaggaagctaatatctgtgaatacaatggaaaagttcgtggaaagcctaattcctgggtggccctttcgacctgcgacggcctctctggcgtagtattcgacggcgaagagatgcactacgtcgaaaaaggaaattcgataggcgacgtagaggccgatcattttttatataaatattccgatttattggaacacaataagacgtgcgggtatgccggggatgcggtggatcccgaaaaagctgttcatgctcataacaataatagaatattaaggtataagagagatacagacgaacaattagtcagg

SEQ ID NO: 149 - DNA, 567 bp, Diabrotica virgifera virgifera
agactgaatgtatctataattcctcaagagcccgttttattttcggaatcagttagatacaatttagatccatttgaaaaatacagcgatgaaatactttggaaggcaatagaaagcgttgaactaaaacatgccattactgatttaaatcaaactgtcagcgaaggaggttcaaactttagtgcaggtcaaagacaactcctttgtcttgcaagagctatagtacgaaacaataaggttcttgttatggatgaagctactgccaatgtagacccaggcactgatgccctaatccagaaaacaatccgtgagaggtttagagactgtactgtacttaccatcgcccatcgacttaatactgttatggattcagaccgcgtgctggtaatggatgccggagaagcagtagaatttgaccatccttttaaacttctacaaaacccagacggatattttagtagaatgcttagagagacgggaccagctatggaagaaatgttgaaggcagtggcagaggaagattataataagaagtacggcggaataaaggggaaaaagggggaatag

SEQ ID NO: 150 - DNA, 330 bp, Diabrotica virgifera virgifera
tgcatgtcagtctcgagcttaaaaaaacaaggaccccactgccccgacgactgcaacggcaatggctggtgcaacaacaaaggccactgccactgcaaagacggcttcgctccccccacttgcgactatcccggacctggcggctccctggacagcggccctgcagcggatcctaatggtcagtatcttgagaaaaagatttgtgagatcactaacaaagctgccgaaaaatacttgcgatctggcatcaatattaaatgtctcattccgttttgttgtccgccgaaacatcctattagaaatcttattttaaaggatttgggtgattaa

SEQ ID NO: 151 - DNA, 493 bp, Diabrotica virgifera virgifera
catagcgatgaaattctatggaaagcgttggaaaatgtatgtggaacttaaaggggttgttacagatctaaatcaacctgttagtgaaggaggttccaattttagcgcaggacaaagacaactcatatgtcttgcaagagccatagtacgaaataataaaattcttgtcatggatgaagctacagcaaacgtggatccgcaaactgatgctctgatccaaaaaacaattcgtgagagatttagagattgtacagtactaactgttgcacatcgattgaacactattatggattctgatcgagttcttgtcatggatgccggccaagctgtagaattcgatcacgcctaccgactattacagaattcagatgggtattttgctaagtttctgaaagatgctggaccaccaatggcaaataagttaagagatattgctaaggaggattattataaaaaacacacgtcgccagaagttattgtcgatgacgattaa

SEQ ID NO: 152 - DNA, 537 bp, Diabrotica virgifera virgifera
gacgaaaacaaaaatacctgttcgctgtacatacagacagatcctcttatttggaggcatatcagagaaggattccctgagcatctagatcctaaaaaacaacaagaagtcaacgaaaaaaccagagaagaaatactctctataattgctcatcatgtcactgccgttaactatatatatcgtgataccaagttcgatggaaaaagtgaacatcgtaatatcaaatttgaagtgcaaagaatcaaaattgacgatgattcatcgtgtaggtgttatcacagaggttgtggagaaatgaaccaattctgcctagagaatatagacgttagcaatttccttaatatccattcgctgggcaaccatgaagacttttgtctggcatatgtgttcacttatagagactttaccggaggcacgttgggactggcgtgggttgccagtgcttctggtgcttctggaggcatttgtgagaagtataagacttacacggagactatcggtggaatgtatcaatccaccaaaaggtctctaaatacg

SEQ ID NO: 153 - DNA, 531 bp, Diabrotica virgifera virgifera
ttggtggcgtttacgataagcgacatgaagagtatttcagctaacatcacagcaggaccacctgtcaaaatttgggcaccagaaaccgacctcagccaagcacaatatgcactagacgtcataatggaattgttaccgtttatggaggattattttgatatgaagtttcctttacccaagttagatttacttgcaattcctaattttggtaaaactgctatggagaactggggcatcatatcttttagaaaatcttcagtcttatttgatcctaattccactagtattaagaccagaagctatatattagcgaaaattgcgcatgagttggtccatcaatggtttggaaacttggttacgatgcaatggtggtctgacctctggttaaatgaagggcttgccacgttcatatcggaaatagcaattacaacgctaagacctaaatggcatgcttacagtagcataaaagttagggatacctataatacactaaatgacgatagtctcaaatcagcaagaagtatgcagagg

SEQ ID NO: 154 - DNA, 489 bp, Diabrotica virgifera virgifera
atgggtcgtggaggatatcactccaatagggcggagttcctttcagacgaagccattttgaaatatagtcgcaatgggggatgttttgttaccactaaaaaagccataggatttgtagtattcgctctaatctctctattaattgtagtattattaatgtattattatggtccgacaaaaactagtgaaaagataattaaagaatcgaatgatatagaaaagttaataaacgacacaataaacgaagaagcgacgaaagaagctctgcggttaccaaaatcattgtaccctctgcattatagactatgggtccatcccattttagatgaacacagtgagaacaactttacctttactgggcgtgtcatcatagaagtcaagtgcattgaggacacgaataaaatcatacttcacgcagatgatctaaacatttccgaatccgattttaaagtatataccacgagacaggttgaaataactacagagcta

SEQ ID NO: 155 - DNA, 451 bp, Diabrotica virgifera virgifera
gaccacttaaattttggaaaagaaaacagttggggtcttttgcttgaaagagaagagaatctgcttgatgaaggatctaaaaccagcgttaaacgaaaaacaaagaatcatacaaacgctgacaggagagatagctcatcaatggtttggcaactatattaccccagagcggtggtctgatgtttggctcaatgagggttttaccacttttttaaagtatcacctcccggatttaactttacaggaattagagactacaaatcaattttcaatcgaaattcttcaggatgctttgtaccaagattctattcaaggtgaagaagaactttcaactattgaaaacactgccatgaatcctaaaactcaggagagaatgaacaagtttaaagctattaaaggtgccagcattatacgaatgatgcaatctacactgggtagaaaaaatatttga

SEQ ID NO: 156 - DNA, 464 bp, Diabrotica virgifera virgifera
tggactgagcatccttctcggaagaaactagaaaaaccagaagtcctaagttgccttcatcaatgacaaagaaagtttacaggtaccctctatggagctactccaaccaggacatggaattattgaccaactcagacttgaccgaagttaccgtcgaaggagacaaccgcacaaacttggaaactctcgttcgcaaaattggatacgccaatacgagagaattcccgacgcccggccgaaggaatttgcgtctcaccaccacagttacctgcgataacggcaaacaagttaaagttccggatgcacaaacttacgttatggttttgagaccccagacgcctagcattatgttgaacggaaccggaaacatggcaaggaagtacgaagacttcagaatgggcgtacgagttctcgctgatatacatataacaggagaacagaagttagacaaatgccaattgacc

SEQ ID NO: 157 - DNA, 435 bp, Diabrotica virgifera virgifera
gaccattcagccaactacatcagcattggaagtgccctcgaaaggaagttttatctcaacggggagcgacatattttcctcccgggggaatacaccgttgctggaacacaagctttgtatgggagggacaatcatttagagaaaattcggatcccgggaccgataatggagcctatcgttatttatatctactacagaggaaacactttcaatccaggagttgaatacaaatactcgatctggaaacaagtgaaacccattgaagtaaaatactcgtggattctcggtgagtggtctcagtgctccgtcacctgcggtggtggtacccaacaacgagaacctctttgccaagagttggtgctagaaagaatgtcatctgaaatagaacgaccaaatatggtgacgaatattactaaccacaagataagcccgata

SEQ ID NO: 158 - DNA, 358 bp, Diabrotica virgifera virgifera
atgtacagtacaagaatatcactattcgtcagcatcttagcatacgtcctctccggatatgacatctccgccgaaaaaagtcttcgtcattacatcattctacagcgtccttcgacaatctctgacggtgttcttccctcaaggtatcgcgcaggtcgcagaagttagaatatctatccaaagactgaacaaattcatgcaatttgaagagatagatatggtcagagaaaagtttggacgatgttctatgagcagtagtaaaagtttggatttatccaaatctgggaatggagttgagaaatctgagaggaaaggggagctgggagtctttttaaacaatgctactgccaagtggagt

SEQ ID NO: 159 - DNA, 254 bp, Diabrotica virgifera virgifera
atgacagaagaaaaaaaacatagtataaaggataaagagaaaattggtattgatgcccaatttgttaatagtgaagaaccaaaggaaaaattaagaatgtatcttttcctcagatgtttaggtatgcaagtacttatgataaatttttaatggtagtaggacttatatcggcaactggaacaggagtcttacaacccctaaatacgattctctttggtagcctcacaggagatatcattgcatatgctacgtcg

SEQ ID NO: 160 - DNA, 4425 bp, Diabrotica virgifera virgifera
atgggacggttgcactgtttattttgtattttcctatgttttaccgtcatcaacacgcagacaacgaatatacatggattctcggaaaattccgtggatacatttctatcacctcatgggaaaagtgcaaaattcgtgcaccaaaatcacaaacccaaaattgaaaattgtcagaactacaaaccctcggtgaaagaagaacagccaggcggaacgtacgtaacaacggttaccgctatcgatgacgatcctagggagggaggaggaacaattagttacaaactaattcatagagaaggagaacatgttttatttgacatagacaacgttactggtgttttgacaactatccagccatttgatcgggatgaaccagtaaggcagaaggaactttatgtaaccgtacaagcttcagacaacggcaggccaccattagcagatgtctgtacatttacagttaccattaccgacattaatgataatgcgccacagcttgataaactgaaatacgatgcacaagtttctgaagatttaaaagtaggaagtgaagtgatgagagtttttgcttacgacattgatgatggggaaaattcaagattatcgtataacttttcaaacgaaaatgctcaattcacccagtatttcaggatagatcgagatactggcgttgtgtatttaaaggaagctttaacagacaaaaagaatactagatttaacagtgctgtttatgtagccgataatggcgttaacgatcaagaaggccaaaaagattcaaccgctaagatatctataacagtagtagggtctgataaacagcctcccagatttactcaaaaaatgcctgatggaatcttggagatccccgaagattttaaagacttttctaaacatattgtcacagtcgaagcaacgtccaacattgcggatccacaacttgcttttgaattggtgaagggaaagacatatcaaaccaataaagaccaaacgtttcttttggaggcagaaggaaataaagcgcacataaagctagtgcgtccactggattatgaaacagtaacggaatatactctaactattcgagtaaaaaacaaagatttaatggattcttccataaatataccaattaaagtattagatgttaatgatgaaattcctaatttccttgaatttcttaaaggtagtgtcgtggaaaatgacaagccaggtgcacaagcgattcaagtaagagcaatcgataaagacggaactgctgctaacaacattgtgagctatgaactcgttgacaatacagatttgtttgcaataaaccgatctacgggagtaattacgtcgagagtggagtttgatcgtgaaactgtacctctatatcacgtaaacgttaaagcttatgataactctccgtctgctttgtataacacgacattgcctaacattgtaattcagacattccaaatcagtatagaagatcaaaatgacaacaaacctgtatttactcatccaatttatcagttcagtaatattactgagcttgctgataaatcgagtattgttggtgaagtcaaagctttagataatgacacggcttcagttataagttatagtattacaaatggaaatattgacgatgcgtttatgattgaaaattctaccggcagaataagagttaatggaaaactggattacgagaaaatcgaacaatacaacttaaccgttcgcgcatttgatggggcatttgaagattttgcaattgttttaatttccatacttaatgaaaatgacgaacctccagtttttgacgactatatcagagaaattcaaattaaagaggaagaacctatgatatccggatgcgttgttagagtgactgctcatgatccagatattaaagacaggcatgctgatcaacacatagtatatgaggtcgcgaaagaacagaaagattttttgaccgtatctgccgatggatgcgtacaagtaacaaaacctctcgaccgagatccgcctttcggtagcccaacacgacaagtcttcatctatgctcgtgataatgatggaggcacaaattcattgttggccactgcagaaattgaaattattttaatagatataaacgataatgctccctttttaaatgttacagaaattgtttattatgaaaaccaggatccaggttttataggtaacctaagtgccgatgattacgatggtcctgataatggacctccgtttgcttttcgattatcagacactgcttcagatagtattagatcgaaattttccattatcggaaaccagcttttcgctttagaaatgtttgatagagaagagcaaaaatattatgacattgccattgacattacagatagtggagtacctccactaacaggaactagtattcttagagttataatcggagatgtaaatgataatccagctacagacggaaacagcacgatctttgtgtataagtacgtcaatgggccagaaaatttcatggaaatcggacgtgtatatgttacagacctagacgattgggatttaaatgacaaagtctttgttcaagaagataactttgatgaatttgtattaaaccagcataacaacggtatgattctgatgaaaccaacaacggctgagggaacctacgaggttcattacagggtcactgaaacccatgaacccacaatacacgaacatacagttaatgcaatagtcacgattacagttaaagtacttccagaggaagcggttgtaaaatcaggatcaattcgattgagaggaacaactaaggaagaattcatagaaaattcattgaatggaaagagcaaaagagacatattacaccaagaactctccaaaatattaaatacatctttagcgaatgttgatgtatttactgttttaaattcaccccaccagaatagttcgtttgtggatgttcgattttctgctcatggatctccatattatgctccagagaaactcgaaaacaaagttacagatcatcaaatggagcttgaacaaaaattagatgtggaattctacatgatcaacgtaaacgagtgccttaacgaaacaacgtgtggagctgaaaactcatgtacgaacaaattaaacataacacgagaaccagctgtagtgtttactaacagaacatcctttgtcggtgtaaatgcatttattgatcctgtgtgtgccgctttaccaagagatgttatggaatgtttcaacggaggcgtccttatcgaaaacacagcgtgtaattgtcctgcaggatttgaaggaccacattgtgaaatcctagctataggatttacaggaactggttgggctatgtatccatcctttgacgctacaaacaggactgagattatactgcatattttatcacaaactgataatggtttgatattttacaatggacctttaaatataagacaaacttctttgtctaaagattatatatcattagaacttaaagacggatatccattacttcaaatttgcaccggctcaagcactcaagaaatttatctgaaagagcgcattcacaaattgagcgatggatcgttacacaaaataaaaataggatctggatttgacgatatatccctggaagtagacgactgtggaacaacgtgttcaatttggactaataaactacataaaggtgttatccgagcaaatggcccccttcaactgggaggtatgaaaaacagattcaccgatcaagaattcaaacgaatttgggaccatttgccaccgactgccacccgtttctctggttgtattagaaatttgacgtataatgaattttactacaacctcggtgcaccttctgatgcattccaagcgtatcccgactgtaactatgcagtgatgcaagctgtgactttcggtatcgactccaatttcttggttgctattctggtttgtgtagcaattttgataattcttcttctggcagtagttgtacatagacgtaaacacgacaactttaacgaaaaagaaatcgatgatactcgcgaaaacattatcaactacgaagatgaaggtggcggcgaatgtgacaccaactacgacctgtctgttttccatcagaacaacattgtggacgaaaaaccattgatgagagacaaccccgatgtacctgcagatataagtggctttttagataacaagaaagacaactgtgataaagaccccgataatttgccttatgacgacgttcgccattatgcctacgagggagacggaaatagcaccggatccttatcttctctcgcttcatgtacggacgaaggagatttaaagttcaactacttatcaagttttggacccagattcagaaagttagccgacatgtatggagaagatccaagcgatgaagactcacacgatggaaacgaagaatcctggtgctag

SEQ ID NO: 161 - DNA, 4002 bp, Diabrotica speciosa
atggcaaaacaagaagaaaatttctttcataaagataggaagaaaccgaacatactatctcggatattcttttgttggatttgcccagttttagtaaaaggaaaccgtagggatgtcgtcgaggatgatcttattgtgccaagcaaaatctataattcaaaacagcagggtgacaaattagaaaagtcttggtcggcagaagtgcaattagcccaaagagaaaaccgaaatccatcactgtgggctgcgttgcggagggcttattggcttgagtatatgactggtgcaatatacatcttgactataactgctgtcagaatcgtgcaaccaatgttatttgcgcagctcttgtcctactggacagtggactcggaaatgacgtccttcgatgcaggagtgtacgccttggcactgctcggcttaaacttcgtcaccatgatgtgccaacaccataacagccttttcgtcatgagcttcagtttaaagatcaaagttgcttgctctgctgtgctctacagaaagcttttacggctcaatcaagtgtccgtgggcgaagtagcgggaggcaagctagtgaatttgctttccaatgatgtggcgagattcgattttgcatttatgttcatgcactacctttggataattcctattcaagtagccatcgtactgtatttcttgtacggtgttggaggctacgctccattcgtagggctgttcggagtcatgatcttgatcttaccaattcaagctggcctcactaaattaacggcttcggtaagacgtaatgtggcgataaggaccgataaacgtattaagttaatgaatgaaataattaatggaatacaagtcattaaaatgtatgcctgggagaaaccctttcaattagttgtgaaggcagtgcgggcacatgaaatgagcgctttaaagaaggctatctttatacggagcgttttcctcggcttcatgttatttacggaaagatcgattatgttcttcacggtgttgatgctcgcgctatctgggaatatgatttctgcaactacggtgtacccaatccagcaattcttgagcaccattctcatcaatttgacgatgatattaccacttgctattgcgacattatccgagatgaaagtgtccttagaaagaattcaaggtttcctggagttagatgaaagagaagcgctttcacataagaatggtattagtaatggagctttaaacagaagccttttcagttctaaacaaggggccatagagtccgatatcactgcgaagaaatatgtttcgaccgatgttgtagagacactacaaagcgaaatcaacaagtctgctaagcctagtgagtttgctgtggatgtgtgcagtgtgactgcctcttggaaggatgtggcctccgaagaagccactcttaagaacattgcgatgcgtgtgcgccacggaaagttatgtgccattattggacctgtaggctccggaaagacatcattgttgcaattattgctaaaagagttactgcctcacgccgggtcgctggccatcaatggaaaggtatccttctcctgtcaggaatcatggttgttcccgggaacggtacgggagaacatcctattcggatcaacttttgattcacaaaagtacaaagaggttacccgcgtatgttgccttgtgcccgactttaatcagtttccttatggcgatcaatccttggtgggcgaaagaggagtcactctatccggaggacagcgggcgcgtatcaacctggccagagctgtctacagagatgctgatatttatttgctggacgatcctctatctgctgtcgacgccaacgtaggtcgactactgttcgaaggctgcatccgaggctaccttcggaagaagacatgcctattggtcacacatcaaattcattatctcaatgattctgactggattgtaatattgaaagatggcactatagagaatatgggaacctacgatgatttagtaaaatctggaaaagatttctcactactactaaaagaactgcaagatagtgatgacaccggtaaagaagaaaatttagaaaagcggccgtcaatgcaacgtggtatgtctgtcaaaagtgaagagaatcctgaagatcaaaaggaacaggtactagaagctgaagaaagagcaaaagggaaccttaagtggacagtagtggcgcagtatctgaagttagttaaatcgtatcctttactgttcctggcagtacttacactactaataacacaagcagcggccaccttcgtcgactactggctcagtgctttgactaacgctgtagacgcttatgttcaaacggtgcctgaagatcaaactcctgatccaagtcttggtaccagtttgggctcactaacaacagggcaatatttatggatccatggtggcgtgatcctgggcatcatcgtattttcacagctgcgaattcttacttttgttattacaacaatgcgtgcttcgcaaaatatccatgataaaatatttaacaacctcattcaagctgtcaaaagattctttgatacgagtccttcaggtcgcgctttgaataggttttcaaaagatctcggtgcagttgatgaacttcttccaaggagtttgctggagactttacaaatgtatcttgctatgaccagcgtattggtgctaaacgccatagctctaccctggactctaataccgacgactttcctggttgttttatttgttttcctactcagatggtatctacaagctgcacaggcagtcaaacgtttggagggcaccactaaaagtcctgtgttcggtatgatcaactcaacaatatcaggattatcaacaataagaagttcgaattcggagtatagattgcaaaatcaattcgacaaagcccagaatcttcattcgagcgcattctatacatttctcggtggatcttcagcattcggcttatatttagatgtgctttgtctggtgtatctcggtttagttatggctacgttcatattatttgattttggtggcacgatcgcagtgggcagcgcagggttggcggtcagtcagtcgatggtgcttacaatgttactgcagatggcagcacgattcacagccgattttctcgctcaaatgacgtctgttgagaggacactcgaatatgccaagctgcccaaggaacaatacatagacgaagggcctactaagccaccgcccatttggcctgccactggacatatcacttttgaaaatgtatatatgaagtatggaccagaagatccttatgtattaaagaatttaaatatcgaaatacgcagtggatggaaggtcggtgttgtaggaaggactggcgctggaaaatcgtcattgatatctgctctatttagattaacgaatattgagggcgctatcaaaatagacggaatcgatacgtacggcattgctaaatcggtgttgcggtccaagatatctattataccgcaggagcctgttttgttctcgtcgactgttcgatacaatttggatcctttcaataaatacagtgacgacgacttgtggcgggcactagaacaggttgaacttaaggaggcaattccagcattagactataaggttacggaaggaggaagcaacttctctatggggcagagacaactattatgtctggccagggctgtgctgcggtctaataaaattttaatcatggacgaagccactgctaacgtcgaccctcaaaccgatgcccttatacaaaagaccatccgtcgagagtttgctgcatgtacggtaatcactattgctcaccgtcttatcaccatcatggactctgatcgtgtgctggtgatgaataagggagaggccgttgaattcgattggccttacgtagtgctttccaaacccgacagccacttcaattttctagtcaaagaaaccaatgatagtatgagcaaagttcttcatgatattgcaaagactaagtattttcaagaaaatccacagtaa

SEQ ID NO: 162 - DNA, 4104 bp, Diabrotica speciosa
atgaacagcaagaaacaagcgcatggccaaaagccaacacaagagaagaacaagagtaaagattcgcctctacaaaaggatgttcctggtattttatcaagattcttcttttgctggatgatgcctttatattacaacggcattaaaagggacttagaagaatttgacctagtgcctgcgaagcatcaatatgattctaaagttgtaggggatttattagaaaggaaatggctggaagaggaggtaaaagcaaaagcggaaggtcgcaccccgtctctcaggaacgtgttgatcaaaacatactgggtgagcttcattcccggcggcattatgcagttcctatatgtatcgatcaggactgtgacaccactcctgttcgcgcaattgctgcagtattggtcggtgaattcaacaatgtcccgtgagacagctgtggtgtatgccgtgagcatgattgccgccaactgggtggctgccttctttaatcaccacggcaacctgtattgccagcagtttggaatgatgttacgcgttgctaccagctcgcttatgtacagaaagttgatgcgtatgaataacgcttccttaggtgacacggctgttggcaaagtagtgaatattctctctaacgatatgcagaggttcgatatggctatgctgttcctccactatgtatggatcataccaattcagatggctgctgtgtgttatttgggttacttgcaggcgggccccgcggctcttgtaggcctagctgctttaatcgttatcgctttgcctattcaaggttatcttggtcagctaattggaaaactgagactacgaattgcggaaaagactgacgagagaattaaagtgatgactgaagttattagtggtatacaggttattaaaatgtacgcttgggagctgccattccaaaatgtggtgagcgagaagcgtggtgccgagatgaaacaagtcaggatcgcgctgctgtatcgtaccgtattcctgggcttcatgatgttcacggaacgagcggctctcttcatcacagttctagtcttcatccttttcggaaacacaatgactgcaaatattatctatcctctgcagcaatttatgaacgcggcgcacatcaacataactttagtgttaccccttgtgctggcttttaccgctgaactcctcgtctccattaaaagaattcaagatttcctgattttggaggatcgtcctgacttggttaagagttcacatacatcttcaccagggaagttattccaaaagtcatcttctgttttcgaaaagattgaagggcccatcagacctctctcttttcaaacacattcagaattcagtgataatgttggtaaacagcaaatgccaccggtaaatcgtatgatgcttcgatcgttgtcgcagcctggaggggataccgctgtggaactacgtaacgtcaccgctagatggaccagcgatcctaacctttgtgccctcaagaatatttcagtaaggataaggagaggcaaacttttcgccattataggtgccgtgggctcaggaaagtcttcaattctacaactattgctgaaagaactacctgctgccaatggaacagtatcaatctacgggaacctttcatatgccagccaagaaccatggctgttccctagtacagtcagagaaaacatacttttcggattgccttacgacgctgaaaagtataagagggtttgtagaacttgctgtctcgagaaagatttcaagcaattcccctacggcgatcagacgttggtgggtgagagaggggtgtccctatcgggaggtcagagggcccgaatcaatttggctcgctcagtatatagagaggctgacatttatctcttagatgacccattatcagctgtggatgcgaatgttggtcgtctattgttcgaaggctgtatcaacggctacctgcggggtagcacgcgaatccttgtcactcatcaaatacacttcctcaaagcggctgactatattattgtgatgaatgaggggcaaatagaaaacatgggtacgtttgaagaactgacacaattgggcaaagagttctcaactatgttggcgtccttgcaagaaggcaaggataaggatggtgatagcattggttctggaggaagtatggagagtaaagaaaagaaacgacctgcaaggactatctcagtcaataatgaggtagaagagtttgaagagtttgaggctcagaaaatgcaagcggaggagcgggcctcgggcaacttgcgctgggatgtcgttgtggcctattttcgttcgggcggtagcatctgtttcatcttgtttactctcttcatgatattactagcctctgctgcatcggctgctacagattactgggtcagttattggtcgaacagcatggcagcatacgaggaatccctcgagggtgctactccggaacctggattagatgtgcaagtaggaatgttcacgaccggccagtacttgattatacacgggtctttagtgttggcgtgtatccttattaccaacctccgtgtgttcccatttgttggactttgcatcggtgcctctaagaaacttcacaactttatgttttctacaatgttaaagggaataatgcgtttcttcgatacgagctcctcaggacgtatcctaaacagatttacaaaagacatgggtgcgctagatgaaattttacctcgaacactgcttgacgtactccagattaacggcgtgttactcggcattttgatactaaatgcaattgctttatactggacattaattccctctgctgtgatgcttttgcttttcttcttcatggttaggatttacttaaagatggcgcaaagtgttaaaagactggaagggacaactaaaagtcctgtgtttggtatagtgacatcatctctaaacggaattgcgactatcagatcagctggagctgagcaaaggctgattaatgattttgacaatcatcaggatttgcacactgctgcgtggaatggttatctctgcggaggtggatcttttggattatatttggacaccatgtgtttggtttacctcacaactgtgatatttgttttcctatatcttgatttcggtgatataatagctgtgggtagcgtcggtctggccgttacccagagcaacatgttgactgccatgcttcagcacggagcgcgtatgctggtagagtttatagctcagctgaccagcgttgaaagaatacttgattacacacgcatcgatacagaagaaaacctcttcgaaggcaaaatagcgtcaatacctacatggccatcaaatggtgcgattatattcgataacgttagcatgcgatattcaccagatgaaccgccagtacttaagaacttgaatattgttatccaaagtggatggaaggtgggcatcgtcggccggactggcgcaggcaaatcttcgcttatatcagccttgtttagattcgcttacattgatggtacaatcaccatcggtaacatagatacagctttggttgctagacaggaactccggtcaaagatctcgataatccctcaagagccagtgcttttctcagctaccatcagatataatttagatcctttcaatatctatagcgacgctgatatctggagagctcttgaacaggtggatatgaagggtgcagtgccatcattggatttcaaagtgacagaaggaggtgctaacttctcggtgggccagcgacagctgctctgcctcgccagggctgttcttagatcaaacaagttgctgatcatggatgaagcaactgcgaacgtggatcctcagactgacagtttcattcagcaaacgatcagaacacattttgcttcatgcacagtgctcaccatagcccaccgtcttaatactataatggactcagatagagtactggtcatgggcgcgggccaagttctagagtttgatcacccgttcatcttactatcggacgctaacggccatctcacgtcaatggtcaaagagacaggggaaaagaatgctaatcaacttctggaagttgcaagagaagcttacttccaaagcaatatgaaagaaaatgcaagataa

SEQ ID NO: 163 - DNA, 5196 bp, Diabrotica virgifera virgifera
atgtatgcaactgcagctcgtgtttctacaagaaaaataaggacattgctgagatcttcaaaagaaagaataatgggagaaaaattggataaatttttgttgttaatgtggaagaattggctgctgcaatatagaaaaccaattcaaaccataatagaaattgtcgctcctgttctcttttcattccttttagtctacatcagaagtttgtcggatccgacatatgaacatgaaagaatatataagccattttgtgctttcgagggaaacttcaaccttagcctaccgcttttttgtaatgacccagatgctgtgcaagcaggaccatcattatttagtaatatgcaagctggtgatagcaatttcagccttacaatattatatactgctccagaagataaatactacgacgatgtaataggcttctttaagttaataccaaaagtcaacactcagcgtgtaataagctcaggcgaattagaaagaatatcattagctggaaactcatcctattatggtatcgagtttggaggggatagagacaatgtagaggttaatataagatttccaggagaaacagtgtatcaattagattcgattggacgtcaaaattggaggaccaacttagtgtaccccgtatttcaaagctctggtccaagatcccccgacaatgctactggatcagcaccaaattattttgctgaaggatttctggccgtacaacattttgtgactactgctcttcttctagcagataagggtattacacacgacgatccacagggaatgtttaattttttgatggacgcgtctaatccatttcctctcatacagatgcaacgttttccattcgcaagttggttcagtgaccaacttctaacagcgcttacgagcatgcttggaatgattgtcatgcttagttttgtctacacttgtataaatacagtcaaatctatcaccacagaaaaagaaaaacagttaaaggaatcaatgaaaattatgggacttcctaattggctacattggttggcttggtttgtcaagtgctttatttttgttataatttcggtagcacttatggtagtacttctcaaagtaaggtggtactcgaatacagaatttactgtatttacctatgcagacccatttgttttgtttgtatttctcctgctatattgttgctctatgatcactttttgctttgctctgagcgtcttcttttccaaagcaaatactgcagcaactatggcaggtttggcatggttcatatcttatgctccttatctcttcatgcagaataactacactgatcttgcattatctactaagctattaacaagtttgttgccaaatactgctatggcttttggatttcaagttgtacttatgtatgaaggaactggagatggtgtgacctggagcactctgtttaaaccaaacaccccagatgacaccttgagcctgggattaatatggataatgatcataataaacacaataatctacctattaattgctctctacatagaggcagtatttccaggagaatatggagtagctgaaaaatggtacttcccattcacaaagaaatactggtgtggaaaaggagctgtatcagattataataactataatgatcattcagcaaatgaattctttgaaaccgaaccaaaccttagacctgggattcagatattcaatctgaaaaaagcttttggcaagaaaacggctgtacggaatctaagcttaaatatgtttgaaaatcaaatcacagttttgttgggtcacaacggagctggaaaaactacgacgatgtccatgttaacaggaatgataagcccaacaaacggcacagcaaaaatcaatggtcatgatatccggttagacatcgcaggagtcaggaatagcttgggcctttgtccacaacacaacatcattttcgacgagctcaccgtcgaagagcacttgtacttcttcagcaaactcaaaggtttgtctaaaagcaaaataacagcagaaatagataaatacgtcaagctgcttgatctggagccaaagaggaaggagaaatccagtactctatcagggggaatgaaaagaaaactttgtgttggaatggccttgtgtggaaattcgaaggttgttatgttggacgaacctactgctggaatggatccatcagcgagacgagtgttgtgggaattattacagaaacaaaaagagggtcgaacaatattgctcagtacacattttatggacgaagctgatcttttaggagatagaatagcaatcatggctggtggagaattacaatgctgtggatccagcttcttcttgaagaagaagtacggtgcgggatacagtcttattatggataaagcgaaaacttgcaatccacataaagttacagaactgctgaagaagtttataccagagatagagatccatagcaatgttggaagtgaactaacttacttgttatctgaaaataatgctcctgtattcgaagcaatgttaaaacaaatagaacaagaatcaaatgaacttggaatcaggagctatggtatttctttaaccactatggaagaagttttcatgaaagttggtgcagaccatggacaagaagaaatttacaatgaaaaacagaaaaaggacaaaaaagaaaaaaatcctatactcacttctgctgatttaggtccagaatctttatctccctcgtacactggtggtttacatttgattgtcaatcagttcgtcgcaatgcttatgaagaagattataggaacctttagatcatgggttttgttggcgattcagatatttttgcctatgataaacgttattatagttatgagtgtaccttcaggaagtgttccctctgttttgccggcaatgcctttaaatttagcaagattcactgaccctattactttaattgagcgatttgacgatccacaaaattatacgaataacttctacggtgttttaaatggatatggaatgtctccaacaaatattgacaatattacccgtataatgttagacctgactgcaactaatccaaacgtagtgcgtagaagttacattataggatcaactttcacagagcaagaatttgaatttggtatcatcaagacaattcatcctgttattacggcatggtttaacaatgatccttaccactcacctggtattgccttaggcatggctttgtcttccgtttacaatcactacactaacggacatattgaatttgttaacaaaccattaccttttaaagctgcaacccaaatagacaacattgttggtggacaatctcagggattccagtttgcatttaatattggattcagtatggcgtttatctcatcattttatgttatattcttgataagagaaaacgtatccaagtcaaaacacctgcagtttgtatcaggagtgaaggtttacattttttggtttgttaatataatttgtgatatgtttgtctacttactggtatgttcagtattattgatcactatatattgtttccaacaagatgggtttaagacaagtggagatatgggtcggctatttttcctattacttttgtttggttggtcgtttatgccaatttattatgtagcatcattaatattcacagttccatcgacgggttacacaaggatgactctcgtgggtatatttatagggaatgcagcttttcttttagttgaagtgcttaaaacgcaaagcacaaacctaaaacgtataggagaaaccttggataacgtttttcttgtgttcccgcactattctttagctacaggaataaacaaatgctacgctatctattcatacaacactctttgtgaaacagtatttgactcgtgtgctcaaaataattttactaaagatgagtgcatttcaaaatttccatccactgtcgctgatatttgtaccaatcttaacgacaactacttttcatggaacaataatggtatcgcaaaaaatgtaacgtactcactgatttctggtgtcttgtggtcaatattactatttatcatcgaatacaaattcatagccagactgatgtactacatcaaccaaaaattcttcccgaaacaaccaattctcattcaagacgaagacgacgacgtatccaaagaaaaagaaaggattcacatggccacagatcatgatatacgtcaaactaacattttagtcgtgaaagatttaaccaaatactacaacaactttttagctgtgaatgggttgtctattggaattgaaaagtctgagtgctttggtttgttgggtattaatggtgcaggaaaaactacaacatttaaaatgatgagcggagatgaaactgtatcttacggtgatgcatggatcgaaggaaagagtgtaaaaactcaactgaagcaagtacaacggaacatcggctactgtcctcaattcgacgctttgctggatgatatgacagcaagagaaacaattatcatgtactgcctactcagaggaatagagtttaaaagaacccaaagaattgcgaatttcttgtctcgagacttcgattttcatcgtcatttggacaagaaagttaaagagatgagcggtggaaataagaggaagttaagtactgttttgtcgttgataggggatccgccagtactatttttggacgaacctacaacaggtatggatccagcaacgaaacgttacctgtgggattcattatgcaaaattcgagacaacggcaagtgcatcgttttaacttctcacagcatggaagaatgtgaagccttgtgcactcgaatagccattatggtgaacggcaatttcaaatgtcttggatccacacagcatcttaaaaacaaatttgcggagggatacaccttaaccataaaactaaagaaattgccagagagcggtggtctggtacatgcagatacagagtcactggagaagtatatcaaagataaatttccttatgctcatcttagagagaaacatcaagaactattgtattattatataaccgacacttccatggcatggtccactatgtttggtatattagaaagagctaagcgaagtgatctgaatattgaagactattctttgggacaaagtagtctagaacaggtattcctaacgtttacaaaacaccaaaatccagaaggtgacgatgttaagaagaagaattag

SEQ ID NO: 164 - DNA, 4665 bp, Diabrotica virgifera virgifera
atggcaaacttaacagaattaaccaccctcccgacaactgtaaccgaattaccaaaattaactagcaactcctcacaacaaaatgcaactattgaagaagaagcttatgcagcgttgagttcattttgtggatctcctttttgggacacaaacctaacatggaacacaaacgacccagagttcacaccgtgtttcgagaaaactgtactagtatggataccgtgtatttttctatgggtcttcgccggcctagaagtattttacatattcaacagcaaacgacgcaatataccatggaactggttaaatttatcaaaattagcaataacagccactctaatagttttaacaattagtgatatagtaaactcattcaaaacggcaggtaacagaggcagcgaagtgaatgatgtggatatttactcgccgttgatcaaaatactaacatttgcccttaccggagtttttattttctacaatagaaagcacggtctacaaacgtccggactgttattcttgttctggttcttcgtcgtcctttgtgccattcctcagttcaggaccgaaatcagaagaagccaaaggaacgagatattgcccgattattactatttttacaccagctacctgatatattttcctctggtcgtgttgatgtttcttcttaactgtttcgcggacaaggcacctttggaaaggaagtatccacaatcacagaatccgtcaccagaagagagtgccagcttcttatcacgtctactcttcgcatggttcgacccgctggcttggaaaggtttcagaaaacctttagaaaccaaagacctgtgggatatcaatgtcgaagatagttcgagggagttggtacccgtttttgaaaaatattggagtcaaactttaaaaaaagccgaaagcacctcccccacacaagttgcccatgccaaatttaaatcagattcggccagcgtcgatttcgttaataacaagaagaagaaacaagcctccatcttaccggcactgttcaaatgtttcggacctatctatttctttggagcgctgttgaagttgatacaagatctgctcacttttgtgagcccccagattttaggtttccttatttcctacactcgattcaaccaagaaatgtggaagggttacctctacgctgttctacttttcatcacagccaccattcaaacccttttcctagctcagtacttcaacaggatgtttgtggttggaatgaggatccgtactgtcttggtatcaacgatttacagaaaagcattgaagatatcaaacagtgcccgaaaagaaagcacagtaggagaaatcgttaatctgatggctgttgatgctcaaaaattcatggatctaattggttacctcaacatgatttggtctgcaccactacagatctgcctgtccttatatttcctctggaaggaactaggaccttctgtactcgccggacttgctgtgatgataatactgattcccgtcaatggattcattgctaacaagatcaaaaaactacaagtgaaacagatgaagaacaaggatgaacgtgtcaagctgatgaacgaaattttgaacgggattaaagttttgaagctgtacgcttgggaacacagttttgaggatcaagtattgaaaatcagaaataaagaaattaaagtgttgaaacaagctgcttatttgaatgctggtacgtcgttcatctggtcttgtgctccattcctggtctctctagtcactttcgctacatacgtattggtggatgaaaaacatgtattagacgcaaataaagcctatgtttctatctctctattcaatatcatacgatttccactcagcatgttgcccatgatgttgtcaaatttagtacaaacttgggtgtcagttaaaagaataaacaaattcatgaatgctgaagaacttgatcctgataatgttctgcacgaaccctctgaagagccacttacgatcgaaaacggcacattctcctggggcgaaggaccaatcttgaaggacatcaacattaacatcaagaaaaaaactctaacggccatcgtcggaacagtcggttcaggaaaatccagtttgatctcagcgttcctaggagaaatggacaaactctcaggccgtgtgaactcatatggaaaagtcgcttacgtctcccagcaagcttggatccagaacgccacccttcgagataacatcctcttcggaaaaccctacgacaaaacgctgtatgacgcagtggtggaagcttgtgccctgaatccagatctggagatgttgccggctggtgatcagacggaaatcggcgaaaaaggtatcaatttatctggaggtcaaaaacaacgtgttagcgtcgccagagcagtctactcgaatgctgatatatactttttggatgatccgttgagtgctgtagatagtcacgttggaaaacacatattcgaaaaggtgatcggtccccatggattgctaaaaagcaaaaccaaaatcctcgtcacacacggaatcacgtatttgccacaaactgaaaaaatcatcgttctgaaagacggtagaatttccgagacgggaacatatcaggaactcctggatagaaaaggagcattcgccgaattccttctccaacatattacagaagaagccgaaaccgaagcagaactcgatgaactcaaagaccaactcgctgacacaccattatctcaagaagtagcaagacaactagtcaggcacaggtctcgcgtctcagaatctcaatcagaaacaggctccgaccacatcggcaacggatctatccaacgcctcaacagcgtggacaaaagcaaccacaaactatccatagatgacggtaagaaaggtccaaagaaaggcgagaagctaatagaaaccgagaaagcagaaacgggcaacgtcagctgggccgtctacaagcattacttgaagtctatcggattggtgtttatgttggccaccttgatttttaatttagtgtaccaaggtttcagtgtcggctccaacgtttggttggggctttggtcagatgatcaaaagatcgtcgtcaacgataccgttgacactgcaagacgagatatgtatctcggggtgtatggtgctctaggtcttggacaagcaattcctgcaatatttaccgacgtatcactacaactgggttgctttgcagcagcagttataatgcacaaaaagttactctctggggttcttagatcaccgatggcatttttcgatactgttcctattgggcgcatattagcaagattctcaaaagacgttgaaactgtggatcacgatttgccttggtttttttcagacacatgtttctgtgtattcgaggtcgtaggtactctagctgtaatcagctattccacaccagtgtttattttagtgataatccccttatgtttcatttactacttcatgcaaaggttctacgtggctacctctagacaagtaaagaggttagaatctgtgtcacgttccccgatttattcgcactttggagaaagtgtctctggagcacatgctatcagagcgtacaatcaacaggaaagatttattgtggaatcggaaaacaaagtggatatgaatcaaatatgttattatcccggaattatatcgaatagatggttggcagtcaggctcgaaatgattggaaacttaattatatttttcgctgctctgttcgctgttctcaagaaagatcaggcgccaggattggtcggtctttctgtgacctattcgctacagattacacaaacactcaactggctggtcagaatgacgtctgatgtggaaaccaacatcgttgccgtcgaaagaattaaagagtacggagaagccccgcaggaagccgcttgggaaatccctagcaagcagacgtccccagcctggccggaagaaggtacagtccaattcaaaaactattcggtcagatatagacccggtttggatctcgtgttgcacgatctggacttcgaaatcaagggtggagagaaggttggtattgtaggaagaactggagcaggaaaatcgagtctaacgttggctttattcagaataatcgaagctgcgcaaggaaacatcctaatcgatggaatccgcatcgacgaacttggtttacacactcttcgttctagacttactattatccctcaagatgccgtactgttttctggaaccctacgtatcaatttggacccattcaacaaacacagcgatgaagacgtatggaggtccttggaacatgcgcatcttaaagaattcgtgaaaggactaccagctggccttaatcacgaagtcaccgaaggcggtgaaaatctgtcagtcggccaaagacagctaatctgcctcgccagagctctactccgaaaaacgaaaattctcatcttggacgaagccacagcagcagtagatttagaaacggacgatctcattcaaaagacaatcagaacggagttcaaagaatgcacagtacttaccatcgcacatagattaaacacgatcatggactcagacagagtcatcgtgctagataaaggcaggatagcagaattcgacagccctgcgcgactgctagccaatgagaattcaatatttgccagtatgtcgagagacgccggtttagcttaa

SEQ ID NO: 165 - DNA, 5229 bp, Helicoverpa zea
atgagattagaaacgaggcacgctagtgccgccaccaagttccgcctgctcatgtggaagaactttctgcagcaatggagacatcggctacaaactgtcgtagagctactattgccagtcgtgacaatggcgctggtgctcatccttcggtggcagataccgccttatcaaatcgatacactcacttaccccgcgttgccagcgcacacactcaactactctaccaatatcctttttgccatgaatatggaagaattatcaattgcatactccccggcaagtccagtgttagatgatgtaatgagaactgctgttattaatttactaacagccaatatgaaagatctgattcctatttttattgataacttaccaccggggatagccaatataacatttccaccagatatgaacttaaatacgtcggccattgaggagttcgtgaagtcacgaatacgagtcgtaccttataacagcagttatgaaataagagggatctacgttgacgaagaaactacacgcagcattatcgctgccgtcgagtttgacgataaactatatggagcagaacagttgtcaaataatttatcttattcgctacgttttcctgagagaccccgtctcaattcgtttttccaaactggagggcgcacctggagatctgacggagtattcccggttttcgaagtgcctgggcctagatttcctcactcgtgggaaggtggtaatgacccaggttacgttaacgaaatgttcgtggcacttcaacaagttatttccatggagctggtatcaagggcaaccgggttggacttgaagtcatttagggtgaacatacagaggtacccgcacccgccgtaccttcacgaccagtcagtggatctgctgcaatttatgttccccctgttcatcatgttgagcttcagctacactgctgtcaacattgcacgggcggtcacagttgagaaggaattgcaattaaaggaaactatgaaaattatgggcctccccacatggttgcactggacagcatggtttgttaaacagtttatctacctatcaatcacagctgttctgctagttgtgttgctaaaggtaaattggtttactaacgacgatggcttcagcgaatatgctgtatttactaatacaccttggacggttttgctattcttcttgatactgtatttatcttgcgcgatatttttttctttcatggtaagcagtatattttcaaaaggtagtacggccgcgttgtttatggcggtggcatggttcctcacttacatccctgctttcctcctggccatggatatcaatatgtcgactgcggtgcaggtcatcacatgcttcagtattaactctgcgatgtcctatggtttccaactaatgctcgctaaggaaagcactggagggctgcagtggggcgacttcatgacgtcaccagggacggacaccacgcgcttcgtgttcggccacgtggtcatcatgctggtagtggactgcctcatctacatgctgatcaccctctaccttgaacaagtgctaccaggccccttcgggactcccaaaccttggtacttccccttccagttgcagttctggttcccaaattataaatcgaaagatgctggattaattttcgaaaatgataatagtgaattcgatgatattataaaagaaaaggatcccacagaccacgaagttggtgttaaaatgcaaaatttaacaaaaatctttgggaataacatagctgttaacaatttatctttgaatatctatgacgaccaaatcacagttttacttggtcataatggtgctggcaaatcaactacaatatctatgttaacaggaaatttaaaggtaactcgcgggacagtgaacgttgccggatatgatatgacttctcaaagctccgcagcccgttcccacattggattgtgtcctcagcacaatatactgtttaacgaactcacggtcaaagaacatttggaattctttgctagactaaaaggatttaaaggcaaagaactgtatgaagagatagactcacttattgaaaaattggaactacaggagaagcgtgactacccctcaaaaggtctgtcaggaggtcagaagcgtcgtctttgtgttggtattgctctgagtggggcggcacgagtggtcttactcgacgaacctacgtctggcatggatccttcatctcgtcgagcactgtgggaactcttacagaaggaaaagaaaggtcgctcgatgatcctgacgactcattttatggacgaagcagatattctcggcgacagagtggctataatggcaaacggtagactgcaatgcgtgggctctccgtatttcctcaaacgtcattatggcgtcgggtataccctggtgatcgttaaggacacagacttcgactttgtgaaatgctccgtacttatcaatagctatattcctggtactattgttaaagaagatcgaggaacggaaatcacttataatttggtaaacgattactcacacgtttttgaagaaatgttgaatgatttggaaagaaatattgataacatcaaatttaaaaactatggtttagttgctactacattagaagatgtctttatgtccgttggtgcagacttaagtccaattaattccgaatctgacgatgctattactactactactgactcgactatcgatgatatattaaaacaagaaatcgattcatctttggaagaactggataaggacgagagtaacgtgacgggcctccgcttgttcggtcagcaagtgctggctgtatggatgaagcagtggctggtgctgatccgctcgccatgggtcatggtactgcagtttttggcgccagtggtactcatcaactccacgctaggagttctgcgttacgtcatgtctttatcaccgaccattagaactaggtggttgtcgttggaagaagggtatacggaaagcgaaactctgctcagcttcaacggtagtgtagcgtcatcagtgggtgccctagccgcgcaagcataccaaagcctgttcgccaattctggagttatggacatggaaatcaacgctatcggaagccagccaatagaagaatattatctaaatagaacaagtgatcccgttgtgatgggttcgctgcggcaccgcttgctgataggctccacatttgacgacaactctgctaccgcctggttcagtaactttggctaccacgatgttgctacatcgcttgcggcaatccactcagctattctcagatctaaaaactctgatgcagtactcaatgtatataatcatccgttggaagcttcgtatatagatcagagtgacgtgcagactatgatagctatgttgtccatgcagttgtcctctggcatcggcagtagtgtgagcattgttagtgcggttttcatcatgttttatatcaaggaacgtatgtcgggggcaaaacttctacaaaatgcagcaggcgtggcgccttctgtgctgtggggcggcgcagcgatcttcaattggttttggttcctcatcacttgtgtttccatcgtcatctcgtgcgtcgcttttgatgtcatcgggttatcgaacgtgcatgaattaggtcgaatgtttttgtgcgtcatggtatacggtgcggcgatgttgccattagtgtaccttttgtcgcttaagttcaagggaccagctgtcggcttcgtgggcttctatttcctcaacgtgcttttcggtatgatgggagcgcaggtggtggaggcactatcctctcctatgctggacacagagcaagccgcccacatccttgactacttactgcagttctacccgctttacagtcttgtcacttctatcaggtttttaaatcaagtcggcctacgggagtatacttgcttacaaggctgtgaatacttgcaggcagtatacccgaatctagagtgtagcatggcaagcatgtgcgaattccacagtaactgctgcgttcgtgaaaacccatacttcgattgggaggaaccaggcgtcctgaggtacttgctcagtatgtgcttctcctgcctaatcttctggttgctgcttatgaccattgaatacagagtggtgcaaaaggtgttcacattcaagaagactcctcctccaatagacgagagcacgttagacgaggacgtgatgacagaggcgaggcgcgcgcgccaggtgccgccgacacgccgcagcgaccacgcgcttctcgctcacgacctctccaagtactacgggaaacatctcgccgtagaccaagtctcgtttagtgtgaacgacggcgaatgcttcggtctattgggtgtgaatggtgccggaaaaacgaccaccttcaagatgctgatgggtgatgagtccatttcaagcggcgaggcgtatgtctccgggcactcggtgcagaggaatctcgatagagtacacgagaatattggatattgtccgcaatttgacgcattatttggtgagctgacgggtcgccagacactacacatgtttgcgttgatgcgcggcttgcgtttacgcactgcagcaccttcggctgaaacactcgcacatgcgcttggcttcttcaaacatcttgataaaagggtgcatcagtattcaggcggcacgaaacgcaagcttaacacggcgatagcattcatgggacgaacacggcttgtgtttgttgatgagcctaccactggagttgatcccgccgctaaacgccacgtatggcgcgctacccgcggcgtgcagcgagcaggtcgcggcgtggtgctgacgtcacatagtatggaggagtgcgaggcgttgtgttcgcgactgaccatcatggtcaacggtcgcttccagtgtctgggaacgccacaacatctcaagaacaaattttctcaaggctttactttaatcattaaaatgaaaactgacgacagtgacagcgacacgcagtcagtaaacagcactaccagcgtagtagatagtgtcaaactatacgtctctgggaactttgaaagtccaaagataatggaagagtatcatggtcttctaacttactacttgcctgaccgtagcatggcatggtcacgaatgtttggtatcatggagcgcgccaaacagatcttacaaattgaggactacagcatatcgcagactaccctcgaacaaatattcttgcagttcaccaaataccaaagagaagaaggaacgacgttataa

SEQ ID NO: 166 - DNA, 3801 bp, Helicoverpa zea
atgaaggactccgacggaaatgggcggcaactgaaaccaggtgacaaggagaatggcaacaagttgccagaccctttaaatggagagttcccgaaaggaaaagactcggacacaagttcagaagccgatagcaaggcagatgaagtcccaagcatagcatttattacactgttcagattcgcgacgaaaaaggacaaaatattcatagtttgtgcgttaatatgctcagtagtggcagcatgttctacgccaatcaacacattactgctagcgttcttactagatgctatggtagagtatggaagttctatcagagatgggacaccggaccctgacaccttcttagaagcattgatgttctttgctatttacaacaccgtcactggagtcgtgctcatcatcctctcgtatgccgccaccgtgctgatgaatatagccgcatatcaccaagtacatgtaatacgacaagaatacttaaaagcagcactaaatcaagattttgcgtattacgatatacataagaacgctgacatagcttccaaaattaacagcgatgtagtgaaactagaagatggtataggcgaaaagctggccactttcgtgttctaccaggcagctttcttcagtagtgtcatcatggctcttgtcaaaggatggaagctggctctgctatgtctcatatcattccctgtcactttgacgcttgtcggtgtcgctggactggttggtgccagatttggtaagaaagaggccatagcctccggcaaggctggtgccatagccgaggaagttatatctgccatacgtacagtgtacgccttcagcggccagtccaaggagatggtgaggtacgagggacatctcagagaagccaggaaaatcaacatcaagaaaggcttcttcaacggcctggccatgggactgttattcttctgtatcttctgcgcatatgccctttccttctggttcggctacaggctgttgtccactgatgatgactatgatatttctactatgatagcggtattcttcggtgtgatgactggttcggcaaacttcggcatatcgtcgactttgatggaggtgttcgggtctgcccgaggcgcaggggcccagatctttaacatgatcgacaatattcccactattaaccccctgctgaatagaggaacaacgccccctaatattcaaggaaacatcgagttgaagaacgttattttccattacccatccagacctgacgttccggtactgaagggaataaatatcagcgtgaaacgaggccagtctgtggcattggtcggccactccggctgcgggaagtctaccatcatacagctgatctctaggttctatgacgtcattgatggcagtgtggcaatcgacgggcatgatgtccgcgacttatctgtccgatggctgcgagaccaaatcggtctcgtgggacaagaacccgtacttttcaacaccacagtcagggagaacattcgctatgggcgtgagaactgcaccaatgaggagattgaagcctgcgctagacaggctaacgcgcatcagttcattatgagactgccgaagggttacgatacattagtcggagaacgaggagcgtctttgtcaggaggtcagaaacagcgtattgctattgcgcgtgcactcgtgaggaaccccaaaatactgctattggacgaggccactagtgctcttgatacctcttcagaggccagagtacagaaggctctcgataaggctcaaaaaggtcgcacaactctagtggtagctcacagattgtcgaccatccgaaatgtggatgtcatatacgtattcaagagcggtgtagtggttgaacgcggcaaccatgacgagctgatgtcgcagaagggacattactatgatatggtcatgctgcagaacctaggagctgaagatactaatgataagtcaagactcatgcgggaaacgtcggaaacaagtgtagaggacgaagaggatgaagaagaatttctcgattttaaaactggagacacagaagacgatgtggacaacgttccagacatttcgttctggagagttctgcggctcaacaagccggagtggaagagcgtcagtctcgccagtatttgttcgctcatgagtggcttcagtatgcctctgttcgctgtcatatttggagacttcctcgccattctatctgacccggaccctgctgtggttttgaatgaagtgcgtaaaatcgcgttgatatttgtcggcattggtgtcttctctggaatcactaacttcatcgtggtattcttctacggtattgcgggcgaatacttgacggagaggctgcggcagatgatgttcaagaaactgctagaacaagaggtcggcttctatgatgacaaggacaactcgactggagctctttgtgcgcgactgtccggcgaagctgctactgtgcaaggagctaccggccaaaggattggcacagtggtccaagcagtaggaacgtttggtttcgcgctagtactatctctggtgtacgagtggcgcgtgggactggtggcgctgaccttcgtgcctgtcatcgttttcgtgttgtataagcaaggcaggatgacatataaggcctcctttggaactgctaagactatggagaagagttctaagattgctgtggaagccgtagccaacgttcggacagtagcatccttgggtcgcgaggacaccttccgacgggaatacgagaagcagttgaaccccgcactgcaggaggccatcaaggcctcgcactaccgaggcctcgtgttcggtctctctagaggaatattcaacttcgtgatcgccgcgtcgctgtactacggaggaacgctcattgttagcgaggacatcccctacgacgtggtgtttaagtctgcacaagccctattgatgggatcatcgtcggccgcacaagcgtttgcgttcgcgccgaacttccagaagggaatcaaggcggccggccgcatcatcatgctgctcaaccgacagtccaaaatcacggaccccgtgcgacctgctgtacataactttaaaggcacaggtgaagccagtctccaaggcatcaagttctgctacccgacgcggccgatgatacaggttctcaaaggcttgcagttggagatacagcgcggcaagacgcttgccctcgtcggcgccagcggctgcgggaagagcactgttatacagctgctcgagagatactatgatcctgatgagggtatagtggctcaagacggcgtacctctcccgaagctgcgcctcgtagacagtcgtcgcgcgatcggcttcgtgcaacaagagccgattctattcgatcgcaccatcggcgagaatatcgcgtacggcaacaacgagcagaaagtcacgcaggacgaaatcatacaggctgctaaacaggctaacatacacaactttatttcgtcactgccgctgggctacgacacaaacatcggcgctaaaggcacacagttgtcgggcggacagaagcagcgcgtggctatcgctcgtgctctcatacgcagacccaagatgttgctgctcgacgaggccaccagcgcacttgatactgagagcgaaaaggtggtacaagaagccctagacgcagctaaagctggtcgcacatgcgtgatgatcgcgcatagactgagcacagttcgcgacgctgacgtcatctgcgtcatacacgacggcttagtcgcagaaaccggcacccacacagaactcatagagcgcaaggggctctactacaacctcaatagaagaggctacgcttaa

SEQ ID NO: 167 - DNA, 3786 bp, Pseudoplusia includens
atgaaggattccgagaatggatggaagcaaaaacctggagacggggatattcggcacagaataccagacctcgacaagggagaatttgcgaaggataaaaacaatgacacatattcagaaccagaagaaaaagacgatgaagtcccgagtatatcatttattaccctgttcagatttgcgaccaaaatggacaaatgtttcatgttcttcgcaattatattctccatgatcgctgcctgttcaacgcctattaacactctgttgttggccttcttgctcgaagccatggtagaattcggcaagtcggtcatagccggtgcaccagacacggaccagtttatgagtgacttattttggtttgcaatttacaatacgatcactggcgctttactgatcgtactgtcgtatgcagccactactttaatgaacatatcagcttacaaccaggtatacatcattcgacaagaatatttgaaagcagctctgaatcaggactttggatacttcgatatccacaaaaatggtgacatagcgtctaaagtaaacagtgacgttgtgaagttagaagacggaataggcgagaaactggccaccttcatcttctaccaggcttcgttcttcagctccgtcatcatggccctcatcaagggctggaagctggctctcctctgcctcatatcattcccggtcactatgacacttgtgggggttgctggactggtggcttcaaggctctccaagaaagaagccgtagcttcaggcaaggctggtgccattgccgaggaggtcatatcagctatccgcacggtgtacgccttcagcggacagggccaggaaattatgagatacgatgaacatctcaaggatgctaggaaaatcaatattaagaaaggcctgttcaacggcttggcgatgggactgctcttcttctgcatcttctgcgcctacgctctttccttctggtttggataccagctcatgcaaaccgatgactacgatgtatctacgatgattgctgtattcttcggtgtgatgacgggatctgctaacttcggtatttcgtcgacgttgatggaagtgttcggtgtcgcccgaggggcgggcgctcagatcttccacataattgacaacgttcccaccatcaaccctctgctgaacaagggaacagctcccgcttctattgaaggcagcattgagctgaagaacgttgtgttccactacccgtccaggcctgatgttcctgtactgaaaggtgtcagtataagcgttcagcgaggccaatctgtggcactggtgggccactccggctgcggcaagtccaccatcatacagctgatctccagattctatgacgtcatcgatggttctgtcgccgtagatggtcacgatgtccgtaacctgcaagtccgttggttacgtgagcagattggtctggtgggccaggagcccgtgctgttcaacaccacggtccgcgagaacattcgctacggacgcgaggacgccagcaacgaggagatcgagaaatgcgccagacaggccaacgctcaccactttattatgaaactgcctaagggttacgacacactggtcggcgagcgaggagcttcactatcaggaggtcagaaacagcgcattgctattgctcgtgctttagtccggaacccgaagatcttactgttggacgaggctaccagcgcgctcgatacttcttcagaagctaaagtacaaaaggcccttgatagagctcaagaaggtcgcaccacaatcgtagtagcacacaggttatcaacaatcaggaacgtggatgtgatatacgtgttcaagggcggcaacgtggtggagagcggtagccatgacctgctgatgtcgcagaaaggtcactactatgacatggtcatgttacagaacttgggtgcagaggaaaatacagagtctaaaggcttgagccgcgaacaatcagtgagaagtgaaaaggaagatgaagatgactttttgggaaatgctgctgatcctgaggaagatgacgaggccgctccggacgtgccattcaccactgtactgaaactgaactccccggagtggaagagcgtgactgctgccagtgtctgctctctgctcagcggctttgcgatgcccctcctcgctgttatcttcggagactttattggtgttctctccagcccggacgatgatgaaattttggcatctgtgagacgatatgctttgatctttgttggtattggcgtattctcgggaatcaccaatttcatagtggtgttcctatacggtatagctggagaatatctaacagaacggcttcgaagacaaatgttcgagaagcttctacagcaagaagtcgcgttttacgacgacaagaacaactcgactggtgcgctctgcgctcgtttgtctggtgaagcagccgctgtgcaaggggcaactggacaaagaatcggcacagttcttcaggcgctgggcacattcggcttcgctttagtcttatcactgatctacgagtggcgagtgggattggtcgccctgacctttgtcccgatcatcaccttcgtcctctacaaacaaggaagaatgacctatgctgagtctgctggaacagcgaaaactatggaagctagctcaaagattgctgtagaggcagtagccaacgtccgtaccgtggcctccctgggcagggaagacaccttccgcaaagagtacgctaagcagctgctccccgccctagtcatggccaagcggtccactcactggcgaggcatcgtcttcggcctgtcccgaggcatcttcaacttcgtcatagcatcgtccctatactacggaggaacgctcatcgtttcagagggactcgattactctgtagttttcaagtcagctcaagctctgctcatgggcgcgtcatcggctgcgcaggcgtttgcttttgccccgaatttccagaaaggcatcaaggcggcgggacgtgtcatcaacctgctgaaccgtcagtccaagatcactgaccctgcacacccagcttatcccgccttcaaaggaactggtgaggcaagccttcagaacgtgcagttcagatatcccactcgtccgatggtgcaagtcctgaagagcttgaacctggagatcgagagagggaagactctggcgctggtgggggccagcggctgcgggaagagtactgtcatacagctgctcgagagatactacgatcccgaagggggtattgtggctcaagacggcgtgcctctcacgaaactgcgtctgatagattcgcggagagcgatcggcttcgtgcagcaggagcccatcctgttcgaccgcaccatcggcgagaacatcgcgtacggcaacaacgagaagaacgtcactgctgacgaagtcatcgacgcggccaagcaggctaacatacacaactttattacctcgctgcctttgggttacgagactaacatcggatctaaaggcacgcaactgtcgggcggtcagaagcagagggtagcaattgccagggctctgattcgacgccccaagatgttactgctggacgaagccactagcgccctcgacacagagagtgaaaaggtggtgcaagaagcgctggatgctgcgaaggcgggtcgcacgtgcgtcatgatcgctcatcgcctcagcaccgtgcgtgacgctgacgtcatctgcgtcattcacgacggccaggtcgcggaaatgggcacacacgacgaactcatcaaactcaaaggcctatactataatcttaatagaagaggatatgcgtaa

SEQ ID NO: 168 - DNA, 4035 bp, Pseudoplusia includens
atggaaagtgaaattaaaaatccacaaatttccattaatgtactgccagctccagaaactcctaaaaagaggcacaaacccaatatattttcgactatatttatttggtggatgtgtccggtgctcataaacggcaacaaaagagacgtagaggaagaagatttaataacacccagtaaagcttatgattcagaaagacaaggcgactattttgaaaggtattggttggctgaagtggaacgtgcggcgagtgagaacagagagccgtcgctatggtcagctatgcggagagcgtactgggtgcagtacatgccttcagcaatatatatcctgataatcaccacagccaggaccgctcagcccctagtatttgcggagttgctttcgtactggtcagtggacagtaccatgtcgacatatgatgccggcttctacgccctcgccatgttgggcctcaactttatatcgttgatgtgccagcatcataactctctctttgtggtacgattcggtatgaaagtcaaagtagcttgttcatcacttctgtacagaaagttgctccggctgagtcaagtatcagtgggggaagtggcaggcggtaagctggtgaacctgctctcgaatgacatcgcgagatttgactacgccttcatgtttttgcactacttgtggatagtcccgatccaagcggccgtggtgctctacttcttgtacgatgtagctgggtatgctccctttgtcggactcttcggtgttgtgatattcatcttgccacttcaagctgcgctgactaaactcactgctgtaatcagaagaagtaccgctaagaggactgacaagagaatcaaactcatgaatgaaattattaatggaattcaggtcatcaaaatgtacgcttgggagaaacccttccagttggtcgtgaagcttgcgcgagcctatgaaatgactgcccttaaaaaatccatcttcgtgaggagcatgttccttgggtttatgttgttcacagaaagaagtatcatgttcttcacaattttgacacttgcgctcaccggcaccatgatctcagctacaattatctaccccattcaacaatttttcagcataattcaaatgaacgtgacattaatcttgccacttgcaattgccagtttctctgagatgcttgtgtcctgcgagcgtattcaaagtttccttattttggaggaacggtcagatatgcaggtaacaccgaaaataataggagggaaaaacaaattgtttaactcgaagaatggacatttagaaccaggcgacgttttgcctaagaaatacgtgcccagcgaactgtcggttacgaagcctgccgaggaaccagttcaatcagattaccccatagtaataaacagagtaagcgcatcttggaccggcagtaataagcctgaagacgtgacgctcaaaaatataagcatgcgtgtgcgcaagggcaaattgtgtgctgttattggtcctgttggttccggcaaaacatctctactccaattgctattgagagaattaccgttaatggatggtactctgaatgtcaagggaaaactatcctacgcttgccaggaatcttggcttttcccaggcacagttcgagaaaacattttgtttggtctcccttacgacgtgactagatataaagaggtttgcaaagcggcctgcttggtaccagattttaagcagttcccgtatggtgacctgtctctggtgggagagcgaggagtgtctttgtctggtgggcagagggctaggatcaacttagctagagcgatataccgcgaggctgatatttacctgctagacgacccgctatcggcagtagacgccaatgtgggcagacagctgttcgatggatgcatcaagggctacttggcggggcgcacgtgtgtgctcgtcactcatcagattcattacctcaaaaccgctgattacatcgtggttctgcatgagggcgctatcgagaacatgggcagctacgatgagcttgcaaaatctggaaccgaattctctaacttgttgtctgatcaagccggcaatagcgatgtcactgatgtcaaaactaatagaccagctatgctgcgaggtatatctaagatatcagtcaagagtcaagaagagcaagatgaagaggaaaaggctcaagttttggaagcagaagagagaggaacgggcagtttgaagtttgaggtcatttggtcatatataaaagctgttcagtcatggactattgtgatactcgcgttggtgtcgctcatgatcacgcagggagcggcaaccacggccgattactggcttagtttctggacaaatcaagtcagcgagtacgaaatatctttagaacccggacaactccctgatactagtttagacgctcaaattggattattgacaacggcccagtatctgatcgttcttggcagtgtaataggaggaataattattatttcacacctccgaatccttgcttttgttgttatgaccatgcgagcttcgcaaaatcttcacaacattatttacgaacagttgattattgcagtgatgagattcttcgataccaatccttcaggacgtgtcttaaatagattttccaaagatatgggtgccatggatgaacttttaccgagaagtattttggaaaccattcagatgtacctctctctcgctagtgtgttgattttgaacgccatagcgttgccgtggacgttgatacccaccgcagtattactggttgtattcgtgttcttcttgaggtggtacatcagtgctgcacaggctgtaaaacgattggagggcacaactaaaagtccggtgttcggaatgataagctcaacgatttcgggactttcaaccattaggagttcagattctcaaaccagactcctaagaacttttgacagtgctcaggaccttcacactagcgccttttatacatttatgggcggttcaacagcatttggaatgtacctagatgccatgtgcttagcttatctcggagttgttttggcaatcttccttttaggagatttcagtgacataattccggtgggtagcgtaggattggcggtgagtcaatctatggtgctgacattgatgttgcaaatggctgctcgattcacagctgatttcctcggacaaatgacagcagtcgagagagtcctcgactacactaagttaccgtcggaggagaacatggagactggaccaaccacacctccaaatgattggcccaaagtagggcaagtggcgttcaataacgtttacttgaactattcgcctgatgacccaccggtactaaagaatttgaatttcgtaatccagagcggttggaaggttggtgttgtcggacgaactggcgctggaaagtcatcgttgatatcggctctgtttcggctgtctaacataacaggtcacatcacaatcgatggtctcgacacggagggaatagctaaaaaggttttgagatcaaaaatatcaataattccacaagagccggtcctgttctcagctacgttgcgatacaatttggatccgtttaacaattacagtgacgaagatatttggagagccttagaacaggtggagctgaaggacggaatacagtcactggaatttaaagtaacggaaggcggcagtaacttctcgatgggacaacgacagctgatatgtttggctagagccgtgttacggtcgaataaaatcctcatcatggacgaagccaccgccaacgtcgatcctcagactgacgctttgatccaaacaacgattcgtcgggagttcgcggcgtgcacggtgctcaccattgctcatcgtctgaacaccatcatggattccgaccgagttctcgtcatggacaagggcgaagccgtggagttcgatcaccctcacatcctactctcagaccctaacagcatcttcagttccatggttagagaaactggagaaaacatggccaaggtcttatttgatgtcgccaagaataaatatgacagcgacaacaaaactgcttaa

SEQ ID NO: 169 - DNA, 4104 bp, Pseudoplusia includens
atgactgaaaaaatgggtacaaaaaaggaagaaaatacgggaacaaaatcgtctcctccgcctcaaccaaagactgttccgaatgtgttgtcacgatcgtttttttgttgggtgttccccttattctacttcggtaacagaagagacttagaagagtatgacctggtgcctccgagacatatctatgattcgaagctggttggcgatcagttggaaagagtttggtatgaagaagaaaagaaagccaagttacaaggaaagacgcccagctttacgagggtattaatcaaaacctttggctggtcgttcctgccagggggtattatacaattcatttctattgctttacgtacggcgtcgcccttgctattcagcgagttgctaaagtactggagcacagagtcggacatgtctcgcgagacggccatgtattacgctatcaccatgatcctgttcaactgggcgtcttcctacgccaaccatcacggcttactgttctgccaacagtttggcatgaagctcagggtcgccacaggctcactaatgtttagaaagattatgcgtatgagcaacggttcgttgggagagacgacggccggtaaggtagtgaacctgctgtccaatgacttgcaaaggtttgacctggcgacgatgttcttgcattacgtgtggatcatcccgatacagctggctgccgtcgtctacctcggctacgttcaggcaggcactgccgctctcatcggttttgcgtccttaatcgtcattgcactgccaattcaaggtgttttaggaaaagccttaggtgctattagattgcgtaccgccgaaaaaaccgacgaaagaattaaattaatgagcgaagttattaacggcattcaggttataaaaatgtacgcatgggagattcctttccaaaaagtggtaggagagaagcgtgccgtggagatgggcgaggtggtgaagggtaccaggctgaggaccgtgttcattggcttcatgcagttcaccgagaggtcagcgctgttcatcactgtactgatgtttatcttgttcgggaactccatgtcagcgaatgtcttctatccgttgcagcagtttatgaatgcggctcagattaacataacgctgttcctgcctcttgtgataaccttcactgcggagctgtatgtgtcgctcgggagagttcaagaattcctatccttacaggaccgaccggacttgtcagaaaagacggagtatattgagtcttccaatttgttccgcaatatgtcgactaaaaggaattccacccagcaagtacgaccgctctcttatcaacagaaatcgaatggatttgccgtcgacgaaatggtggagaagccagtgatcccgtacaacagaaggttctcacgaagcgtgtcggtgcaggaggactgcgcgctgaagctgcacgacgtgtcggccagctggaccggcgaccccaacatgatggccatcaagaacgtctccatgaggctgaggaagggcaagctctgcgctattattggacccgtcggctctggaaagtcctcgattctgcaactactactaaaagaattgcctccggcgtctggcagtgtttcaatatacggccagatctcgtacgcttgccaagaggcgtggctcttccccagcaccgtccgggagaatatacttttcggtctgccttatgaacccgaaaaatacaagaaggtgtgtaaggtgtgtactctggagaaggatttcaagcaattcccgtatggcgaccagacgctggtgggcgagcggggggtgtcgctctccggaggccagcgagccagaatcaatttggcgcgcgctgtgtacagagaagctgacatttacctgcttgacgacccgctgtctgccgtagacgcgaacgtcgggcgtctgctgttcgagggctgcatcaacggttacctgcgcaagcgcacgcgcatcctcgtcacacatcagatacatttcttgaaagctgccgacttcatcgtcgtattgaatgagggtcgtatcgaaaacatgggaacatttgacgagttggttggaagcggcaaagacttcgcgcaaatgctcgctggattacaggagggcaaagacaaagacgcagagagtttgggatcacatgcgagtctcgaagacaagcccaggcctgcgctcaaaacaatggccagtgtgaatgaaggcgaggatctcgaggagtttgaggagcagaagaaagaacaagaggagagatcctcaggcaacctgcgctgggaggttgtcctcacgtactttaaatccggcggcaacctgtgcttcgtactgtttaccgtgggcgtggtactgcttgctgtggccagcggcgcatcggttgactactgggtcagttattggacgaatcagatggcggtccacgacgccaccggcggcggctccaccgactcggattcaggtccaaactttgatgagcaggtgggcttgttcacgaccggccagtacctgatcatccacggctgcctggtcttatcttgcatctttctgaccaacatgcgcgtgtttccattcgctcacctctgcaacacggcttccatcaatctgcataataatatgttctccacaatgctcaggggagtcatgaggttctttgacaccagtgattcaggtcgtatcttgaataggtttacaaaagacatgggtgctttggacgaaatcttgccaaggacgctactagacgttatccagatgtatggatctttggttgcgatctttgttctgaatgccatcgccttgtactggacacttgtaccctccgctgtgttgggtacacttttcttctttatggtccgggtatacaaaaaagcggcgcaaggaattaagcgattggaaggaacaacaaagagtccgatgtttggtgtagtgacatcgtctctcaacggcattgccacgatcagatcgtcgaactcgcaagataggctcatagaacaatttgataccgaccaggatttacatagctctgcatggaactgcttcttgagtggtggagctacgtttggtttctatttggataccatatgtttagtgtatctgacagctgttatatttgtcttcctcttcctcgactttggtgaatcggtcccagtgggcagcgtgggcctggcggtgacgcagagcaacgtactagtcatgttactgccgcacgccgcgagagttctcgtcgagttcttggcccagctcaccagcgtcgagcgaatcctacagtacacgcacatcgataccgagcctaacttattccaaggaaaaatcgatatgccgcccacatggccttctcgaggatcgcttatttttcaaaatgtatccatgcgatatgcgcctactgaggagcctgtactgaaaaacttgaatattgttgtagaaagtggatggaaggttggcatcgtggggcgaacaggagcgggtaaatcttcgttaatatcagccctattcagattcgcgcatatcgaaggatcaatatcgattgatggaatcgatacttcgcttatatcgagacagggcctgcgatcgaaaatttcaattattccgcaagagccaatcttgttctctgcgtctatcagatacaatttagatccgtttaatagctttagtgacgacgacctctggagagctttagaacaggttgatttgaagcccgttattccatccctagatttcaaagtcacagaaggtgggtctaatttctcagtaggccaacggcaacttatgtgtttggcgcgtgctgtgctcagatctaatcagatattggtaatggacgaagccacggcgaacgttgatcctcagactgacaacttcatccaagaaacaatacgacgtaggttcgcgtcatgcactgtgctgacgatagctcaccgcctcaacactatcatggactcggacagagtgctcgtcatgagctctggcgaggtcgcagagtttgatcatccttacgtgttactctccgaccccaatagtcatttctcttccatggtgcgagaaactggtgaaaagaatagtgcaaacctgttgcggatagccaaggacgcttatttccaaagcaatctgaaagaaaatgcgagataa

SEQ ID NO: 170 - DNA, 4908 bp, Spodoptera frugiperda
atgcggctggtaccgaagcaggcgagccccttcgcaaagttccggctgctgatgtggaagaacttcctgcagcaatggaggcacagaacgcaaacagtcctcgaaatactactcccagttctcaccatgacgctggtgctaatcctacgatggcagatagaaccagcagaaagagaaacacaaacctacccgcctttcagagcaaacacactcaacttttccactgttgtactgtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggtgcagaatcattgtccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggttacgtaaacgaaatgttcatagcactacaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgcaatcaacattacaagggcggttacggtggaaaaggaattgcagctaaaggaaacgatgaaaataatgggtctccctacatggttgcattggactgcatggacctgtaaacagtttgttttcttgttagtatccgcaagtctgacagtgatacttttaaaaataaattggttcacaaacgaagacggcttcagtgagtacacggtgtttactaacacgccttggacagtcttgatgtttttcacgatgctgtacttaacttgcgttatctttttctcatttatgatgagcagctttttctctaaagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggcttgcagtggggcgacttcatgtcggcaccagggacggactctaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttcccgcattacaaaccaggtacagttttggttttggaaaatgaaaacagtgaatttgaagacatcataaaggaaaaagaacccaatgaacacgaagtgggcgttaaaatgaataatttaacaaaaatctttggagctaacactgcagtcaacaatttgtctttgaatatttacgacgatcaaatcacagtattacttggacataatggtgctgggaaatcgactacaatatcaatgttgacaggcaatttggaggtaacccggggtactgtgactgtcgcgggatatgacatgacccacgaaacttatgcggctcgtgcccatatcggcttatgtcctcaacacaatgtactgtttaacgaactcacagtcagagaacatttggaattctttgccaggttgaaaggttttcggggagcagagctcaagtctgagattgatactcttattgaaaaattggaactacaagacaagcgagactatccctctaatggtttgtctggaggtcaaaagcgacgtttatgtgttggaatagctttaagtggagcagcacgtgtggtactactcgatgaacctacttcgggaatggatccttcttctcgtagagctctctgggaacttttgcagaaggagaagaaaggtcgatcgatgatcttgaccacgcatttcatggacgaagctgatattctcggtgaccgagtggcaattatggcgcaaggccgcttgcagtgtgtgggttcaccttatttcctgaaacggcattatggcgtcggatacactctggtagtcgttaaggacgatgactttgatttcgaggaatgcactagacttataaataaatacattccagacacggttgttaaagaagaccgcggtacggaaattacttataacttaatcaacgattattcatacgcctttgaagaaatgctgaacgatttggaatgtaatatggaaaagataaaatacaaaaactatggtttaactgctaccactttagaggatgtgtttatgtcagtcggttcggacttggcaccagtaaataattcagataacgatgacgctgttactactacgacggactcgaccattgacgacattttgaaacatgaacttgattcgtctttagaagaattggatagagacgaaagcaatgtgaccggtttccgattgctatgtcagcaagtattagcagtgtggatgaagaaggggctgacactgattcgctcaccttggttgatgatcttgcagttcttcgctcccgtcatactcatcaatgccacgcttggagtcatgagatacgtgatgtccttaaccccaactataagatcaagatttttatcattgactgaaggattcacgagtacagaaaccttgttaagtttcaacggtacattaggatcatctgtcggcgctatcgcggcagcagcatacgagatgatgttcacggcctcagacgtggaaaacatgggcgtgactcgcattgggaacgtacccatggacgagtattatctaaataggaccatggatccagtggtgatggggcagttacgtcaccagatcctgattggctccactttcgacgataacaatgcgacactttggttcagtaacttcggttaccacgacgtcgctatagctctatctaccttccactcggcttttcttagagcattcaactccactgcgcagcttaacgtttacaatcatccattggaggctacttatagagaccagacggacatgcagatgatgattgccatgctctctatgcagctgtcttctggtattggtagcagcgtcagtatcgtcagtgctgtattcatcatgttctttatcaaggagcgcacatctggcgctaagctgttacagaaggccgcgggagtacaaccagcagtgctgtggggtagtgctgctgtcttcaattgggcttggttcctgatcacctgtgtttccatagtaatcacgtgtgccgctttccaagttattggactgtccactgctcaagaattagctcgaatgtacttgtgcgtgatgctgtacggtgctgcgatgttgccgctggtgtacatcctgtcgtttgcgttcaatggacctgccgttggcttcgtcggttattactttatgaacgtgctttttggtatgatgggtgcacaaatagtggaagcactgtcttctcctcagctgaacacagcggaagccgcgaatatactcgactacatattacagttcttcccgctttacagtttaatcactgcagtcagatttttgaaccaagttgggctgcgtgaatacacttgtctacaaatgtgcgagtactatcaagctgtgtcgcctaaccttcagtgcaccatggaaagcttatgttcacgcaacgaagaatgctgtgtcgagccgaatgtttatttcaaatggaatcagcccggcgtatcgcgatacttgacaagtatgattatatcctgcatcgtgttctggacgattcttatgatcatcgagtacagagtcttccagaagttatgtacgatcaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacggaaaacatcttgccgtaaatcaaatctcatttggcgttaacgacggtgaatgtttcggtctgttgggtgtaaacggtgccggtaagactaccaccttcaagatgttaatgggtgacgagtctatctcaagcggtgaagcgtttgttagtggacactctgtcgagaaaagtcttggcaaagtacaccagaatatcggttactgtccccagttcgatgctttgtttggtgagctcacgggccgtgagacgctacatatgtttgctatgatgaagggtctgcgtttacgcagtgctgcaccaaccgctgaaacattagcacatgcactcggtttcctcaaacatcttgacaaaagggtaaatcaatattcaggaggaacgaaaagaaagctaaacacggcgatagcattcttgggacgaacgcgtcttgtgttcgtggatgagcccaccactggagtagatcctgccgctaagcgacatgtatggcgagcaacgcgtggggtacagcgcgctggccgcggcgtagtgctgacgtcacacagcatggaggagtgcgaagctctttgctcacggctcactatcatggtcaacggacggttccagtgtttcggcacaccgcaacatcttaagaacaaattttctgaaggatttcacgttaattattaa

SEQ ID NO: 171 - DNA, 4908 bp, Spodoptera frugiperda; identical to SEQ ID NO: 170

SEQ ID NO: 172 - DNA, 3918 bp, Spodoptera frugiperda
atgggatttaggaaaaagaaatctgaatcaagaccagaaaatgaactggacatatcattcataggcatttttcgatatgggaccttccttgagaacacggcgacattcctgggcattttcataagcatgataagtggcggaggcatagcatacaacttgatacaagttggtgagctgagcactgcatttgtggaacgcaccagttttcaagaccagcctagcagtaacatgccacttctgtcgatcttcggtggtgggaaaagactgaacaatgcaagtcacgaggagaatatggaggctctgttacaagatgctacggctatgctgattggtgcgtttgtgtcagtgggtatatcactgctgtgctgcaccgtctccgtcgctttgatcagctggagtgcactgagacagatcacgacaatacgaatgcggtttctggaggcagtactccgacaggacatggcctggttcgacacggacaacgagttcaacttggcttcgaaaatgtctgaaaatttgatgaaactgaaggaaggcatgagcgagaaattagcggttgtcggtaacttgttgggcacgtcggtgatcagcatcgcagtagccattccactgggctgggagctggcactggcctgcatcactgtcatgccattctctgtagcggcctccgtctacctaaccaattatcaaacgaaatcgtcagcacgtgaattggagtcttacagtcaagcagggaagcatgctgaagagatacttaaatcgataaagacagtagtggccttcggtggggaagagaaagaagttaggaaataccgcactttactggagccagcagagaagtatggacgcaaacggggtatctacacgggggtcggcaacgggttcaactgggtgctcacgtactgcctcaacgccatcggtctcgtgtacggcatcaggttggtgttggaggatcgagacaaatctgaagaagaacgcagatatgtcgtcggtgttgtctttagcgtgctgttcaacgtttatatggcgacacaatcgatcactctgtgcgtaccacacttcgaagtgtttgctgcggcccgaggcgctgctgccaccgtgtactacctgttggaaagagaaccagccatagacagtctcagcacacagggtctgtcacctcgtcgagtggtcgggaatatatctttcgaagatattcacttcaattacccttcaagacctgacgttaaggtcctaaaaggtttctcactccacatcaaggcaggagaatgtgtagcactagttgggtcctcaggctgtggaaagtcaaccatattacagctgttgcaacgactgtacgatccccagtctgggtctgtcaagcttgatggaaaagaattaagaaatctgaacttaggatggctgcgatcatctttaggtgtggtaggtcaagaacctgtactgtttcacgggacgatattcgagaacatcgctatcgcttgtccagaagcaactttaccagaagtacaaagagtagcagccatggcctacgcacatgagtttattacaaacttaccgaagggttatgacacagtgataggagagcgcggtgcttctctatcgggcggtcagaagcagcgcatcgccatagctcggtctctgctgcgggagccagctgtgctgctgctggatgaggccacctccgcactcgaccctcactctgaacgtaaggttcaggctgcattggaccgtgccagcgctggaaggaccactattatggtctcgcacaggttgtcgacgatactgaatgcgaaccgtataatatgcatggatcaaggcgttatagtggaacagggaacacacgaagaactcatgaagagtaaaggtttctactacaagttggtgacaacgaataaacagaaaggagagccagaggaagccactgaatctttgccggagttattggaagaagataacgagtccgctgttaatagccctgtggtgcgaagcgaaactaagaagaatagaccaagaatgagcaaacagaattcagtaatagaatctttcgaatggatgcaaactcctcgaggatcagtcacatcagccgtgtctctgggttaccaaagtttcctgcacaatcaagatatcgacaaagataacagtgatgatgaggaaattgtacctttgagcagttgggatattttaaaactcaatgctccagagtgggtttacattacgattggatccgtcgcagcgttcctacaaggagcatgcttcccagcatttgcgttgctgttcggttttactagcggcatctttgtactgacgaatcgcgatgaactgatatccttgggtgacatgtatgcaggccttttcgttgtggtagcagccattgctggtgtgtctatgtgtctccagagctctacatacaccactgctggtttgaaaatgactaccagacttcgagagttgtatttcaacgctttacttagtcaggaaattggatactatgatagagaagcgaatacagttggagcactttgtgcgaggcttagtggagacgcagcggaggtgcagggggctactggtttgaggatcggactcatcttgcagggcgtcagctctgtggttctaggagtcttgatgggattgagtttcgattggcaactgactctcgttgccactgcattcttacctattatgataggcagtatctggctagaaggcatgatgtcacgcaaatctcaggaagacgagagagatgctatggagtctgcgactggagtagccacagaagcaatagttagcatcaaaactgtgcaaagtttaggcatagaaccagtatttctggacaagttccaggagtcgttgacggcagcttgcagagcggtggcacagaagtcaaggtggcggggtgtggttctgggcattggtatctacgctccattgattgccttctgctgtgcaatcatgtacggcgcctatctcgtttccaaagggcaattggaatacaaaatagtgcttttagtaacagaaagtgttatgttcggagcgtacatgcttggtcaaacactggtgtacgcaccaagtttccacgccgctaaggtttccgcagccaggattataggattgatccagagacagcccctggtcagaacagaagatggtgtcactgacaaaaaagattggagtgctaccggtaacttcagtttaaaagaagtcgaatttagctaccctacaagaaaacatcataaggtactcaaaggaattgatttacacgtggatgctggcaaaaccgtggcgctagtgggtccctctggctgtggcaagtcgactgtactacaactgttgcagagattctacgaccctgactctggaagaatagaattagatggacttgacaatcgctcgtcgctcacgctgccccggctacgtcgtcagctgggcgtagtgcagcaagagcccgtactcttcgaccgcacgctcgctgaaaacatcgcttacggagacaacacgaggaaggtcaccatgcacgagatcatcgaagccgcgaaagctgcaaatattcacaccttcatcagttccctgcccaagggttacgacacaaacctagggtctggtggagcgcagctgtctggcggacagaagcagcgagtgtgcattgcgcgcgcgctcatccgggcgccgcgactcttgcttcttgatgaagccacttctgcgctagacgcgaatagtgaacgggtagtatcagaagcactagaaaaagcagctgaaggtcgaacgtgtgtaacgatcgctcaccgtctcactaccatcaaagacgcagatataatctgtgtcctggataaaggtaaaattgtggagcgtggtaatcatgcagatttattgaagctaaaaggccactactggcgaatgtgcagagggcaggaagctccataa

SEQ ID NO: 173 - DNA, 4551 bp, Spodoptera frugiperda
atgtcttacaattccacgcttgatagcttctgtggatctgaattttggaatagcaatctcacatggtataccgacagcccagagctaacgccatgcttccaaaaaacagtgctggtatggacgccgtgtttgtacttatgggtcgcggcgttccttgacacctactacatactgaacagtaaagaaagaaatataccatggaatatactgaacatcagcaaacttttcataacttgccttctgatagtgttaaaatttgtggatctgggcgtaacagtgcacacctcatcccaagaggacatggcagtatttagtgcagattattatagtcccattattaaaattttaacatttggtttatcagctacattattgtactacaatcgaaagtatggtatgcgagcatcaggagtgctgttcttcttctggctacttctgattttggctggactgcctcagctgcagtctcagatcaaagcacacgccaatatccccgatgatgaaaatgttaaatataactttgtcagttacatggtctactttccgctgatagttattatgtttatattgaattgtttcgctgatttacctccgaaagattcaccgtacaaatatgaaaagaatcaatgtccggagaacgcttcaggattccctagtcgtctaacattcagttggttcgaccctctcgccttaactgggttccgtagaagcttgacagaggaagatttgtgggctctcaaccctcaggactcttctactgaggtggttccgaagttcgacaaattctgggagaagtctttgaggaaacgagaaatttcaaacgcaacaaaggcatcgtatcgtaagacatcagctagcgtcaactttaagcctgagagtgagaagaagccggcttccatattgccagcgctatgccttgccttcggaggccagttcttgttcggagccatgctgaagctgttcaacgacgtcctcatgtttatatcgccacagttgctcaaacttcttataggattcgtgcaaggtaaagagccgatatggaaaggttacgtttacgcggtagcgctgcttgcctgtgccacggtgcagaccatgctcctggcgcactacttcacgagaatgtacctggtgggcatgcggataaggactgccttgaccagcgccatctacaggaaatcactccgtatgtccaacgcagcaaggaaagagtcgacggtcggagagattgttaaccttatgtcggttgacgctcaaagattcgttgaactgactgcatatttaaacatgatatggtctgcgccgttgcaaattgctcttgccctttacttcttgtgggggatcctaggaccctctgtactcgcgggtttggcggtgatgattatactgataccagtcaatggcctcatcgccaacagagtcaagacacttcaaataagactcatgaaatacaaagatgaaagagtcaaacttatgaacgaagtacttaatggaattaaggtccttaaaatgtatgcttgggaaccgagtttcgaagatcaaatacttaaaataagaaacaaagagatgaatgtattgaaacagaccgcttatcttaactctgctacctcatttatatggtcttgcgcacctttcctggtgaccttcctaaccttcttcacatttctgataactgatcccgagaacaatgtcctgacagctgaaaatatattcgtgtcgatgtctctgttttacacaatgcacttgcccctaggtttactaccactcatcgtggtatcagcgatcgagacatccgtcggtattaagagattgaacaaattcatgaactgcgacgaactagacattacatccgtggaacacgatcctaaagacccgaacccaatctctattgagaatggtcacttcacgtggggagaccaggattcggagccgtctctcaagaacatcaacctgcacgtaccacgaggctcaatggtcgccatcgtgggcgctgtcggctctggaaagagttctctgctctctgcattgttgggtgaaatgaacaagatttctggacgagttaacacgaccggtagcatagcgtacgtgccgcaacaagcgtggatccaaaacgcaacgctccaggacaacatactgttcggcaaacccctcgacaaacaaaagtacaacaatgtcatcgacatgtgtgctctcaaacctgacttcgaagtcctgcccggcggagaccaaactgaaatcggagagaaaggtataaacctgtctggcgggcagaagcagcgcgtgtccctagcgcgcgcggtgtactgcgacgcggacaactacttcctcgacgacccgctcagcgccgtcgactcgcacgtcggcaagcacatcttcgacaaggtactgggtcccaatgggctgctgaagaacaagacgcgggtgtgggtgacccacaacgtgtcgtacctggcgcagacggacctagtcgtagtgctgcgcgatggagaggtctcggaggccggctcctaccaacaactgctcgagaagaagggcgccttcgccgaattcctgctacatcatctgagcgacgctgagaggacttcaccagaagaattggacgagatcaaacaagacctagagagtaaacttggaaccgagttccagaacaagttacagagagctcgttctctttccgagagtgcatctgaatccgaacaggcggcaggagaccgcgcaggcagcgtgaagagaaagactccagaagcgactccaaacgaattgaaagagaagaataaacttattgaggctgagaaagcggaaactggcagtgtgaaatggggcgtgtacaagcattacctgatgagtgtcggagtgttgtcgtctgtgatcactgtactcatgaatctcattctacaagtattccaagttggatccaactactggctcactgaatgggccaatgatgataaaatgctggtgaacggcacggtagacacgaagcgacgcgacatgtacctcggcgtgtacggcgggctcggtattggacaagtggtgtcggtgtcggtgtcgtcgctggcgctgtacctgggcacgctggcggcggcgcgcgcgctgcacgcggcgctgctggccggcgtgctgcgcgcgccttccatcggcttcttcgactgcacgcccgtcggccgcgtgctcaaccggttcagcaaggacgtcgacgtcctcgacaacgtgctgcccatgacgctcaggggctggacttcctgcttctttgcggttttgggtacgctgttcgtgattagtttctcgacgccgatattcatggctgtgatactgcccatcggattcatctactacgtgatccagagattctatgtggctacgtcacgacaactgaaacgactcgagtccgtatctcgatctcccatctactctcacttcggtgagagcataaccggcgctagcactattcgagcctacggcgtctccgagaggtttgttgaagagtcggagcgcggtgtagatcacaaccagtcctgctactacccaagctgcatcgcaaacagatggctggcagtcaggctcgagatgattggcaatctcatcatattcttctctgcgatgtttgctgtgctcaacagagacacgattagtgctggtctggtgggactttctgttagctacgcgttacagattacacaaactttgaattggctcgttcgcatgacatcagaagttgaaaccaacattgtggccgtggaaaggataaaggaatacgccgaaacagaacaggaagcggcgtggacagtggcgaacggtccgcccgcggagtggccggcgacgggcgcgctgcagctggagcggctgacgctggcgtaccgcgccggcgccgagcccgcgctgcgcgacgtcacgtgcgccgtggcgccgcgcgacaagctcggcatcgtgggccgcaccggcgccggcaagtccacgctcacgctggggctcttccgcatcgtcgaggccgtgggggggcgcatcctcatcgacggcctggacatcgccgccatggggctgcaccagctccgctcgcgcatcaccatcatcccgcaggaccccgtgctcttctccggcacgctgcgcatgaacctcgaccccttcgagaccttctcggacgaggacatctggcgcgcgctggagtacgcgcatctcaagcccttcgtgcaggggctcccggcggggctgcgccacgaggtgtcggagggcggcgagaacctgtcggtgggccagcgccagttggtgtgcctggcgcgcgccctgctgcgcaagactccgctgctggtcctggacgaggccacggccgccgtggacctggagacggacgagctcatccagaagacgatccgctccgagttcgcgtcgtgcacggtgctcaccatcgcgcatcgcctcaacaccatcatggactccaccaaggtcatggtcctcgacaaaggacaactcgtcgaatatgcaccacctgaacaactgctacaagataagaactctatattctatagcatggccaaggatgctggcctagttaattaa

SEQ ID NO: 174 - DNA, 4041 bp, Spodoptera frugiperda
atgatggacaaatctaataaaaataccgcgtcaaatggcacggctgtgggcgaaccaaaggagagagtaagaaagaaaccaaatatattgtcacgtatattcgtttggtggatattccctgtgctcattactggcaacaagcgtgatgtagaagaagacgatttaattgttccgagtaaaaaattcaattctgaaagacaaggagaatattttgaaagatattggttcgaggaggtagcaattgctgagagagaagaccgagatccttcgttatggaaagcgatgcgccgcgcttactggctgcaatacatgccgggagctatcttcgtgctgctcatttctggattaaggacagctcagccattgctgttctctcagctcctgtcctactggtcggtggacagcgagatgtcgcagcaggatgctggtctctatgccctggctatgctggggatcaacttcatcaccatgatgtgcacacaccacaacaacttgttcgtcatgcggttcagtatgaaagtcaagatcgccgcctcgtcactcttatttagaaagttgctccgcatgagtcaagtgtcagtgggcgacgtcgccggtggaaagttagtgaacttgctgtccaacgatgtcgcaaggtttgactacgcgttcatgttcctgcactatctgtgggtggtgccgctgcaagtcggagtcgtcctgtacttcgtgtacgatgctgctggatgggcgccatatgtcggtctttttggagtgattatattaatcatgccacttcaagctggtctaactaaactcacgggtgtggtgaggcggatgacagctaagagaactgacaaaagaattaagcttatgagtgaaattatcaacggtatacaggtcatcaaaatgtacgcttgggagaaacccttccagctagtggtgaaggcggctcgtgcgtatgaaatgagtgctcttaggaagtctatcttcatcaggagcatgttccttgggttcatgttattcactgagcgaagtgtcatgtttctgactgtgctgactctagcgctgactggaaacatgattagtgccactctgatttatcccatccaacagtacttcggtattatcacaatgaacgttaccctcatcttaccgatggcgtttgcgagtttctctgagatgttgatatccttggaacgtattcagggattccttcttttggacgagcgttcagacattcaaattacaccaaaagtggtgaatggtgctggaagtaaactgttcaacaattccaagaaggagggaggcctcgagactggcattgtgctgccaacaaaatactcacctaccgaagcgaatattgccagacccatgcaggatgagcctaacatggctgactatccggtgcaacttaacaaagttaatgcaacatgggcggacctcaatgataacaaagaaatgacactcaagaacatatctttacgtgttcgcaaaaacaaactatgcgctgttattggaccagtgggatcaggaaagacctctcttcttcagctccttttgagagagttgccagtgactagcggcaatctcagcatatctggtaccgtatcctacgctagtcaggagccttggctgttccctgcgactgtgcgggagaacattctgtttggtttggaatataatgtcgccaaatataaagaggtttgtaaagtctgctcattactgccagactttaagcagttcccgtacggtgacttgtctctggttggggagcgaggtgtgtcactgtctggtggtcagagggccaggatcaatttagccagagctgtctaccgcgaggctgatatttacttgcttgacgatcctctatcggctgtagacgcaaacgtcggcaggcaactattcgacggctgcatcaaaggatacctcagcggcaagacatgcatcctggtcacccaccaaattcactaccttaaagctgcagactttattgtagtcctaaacgagggttccgtcgaaaatatgggctcgtacgatgaactaatgaaaactggaacggaattctcgatgctgctctctgaccaagctagtgaaggctctgacactgacaaaaaagaacggccagcaatgatgcgaggaatatcaaagatgtcagtcaagagtgacgatgaggaaggtgaggagaaggttcaagtattggaagccgaagagagacagtcgggcagtctgaagtgggatgtgcttgggaggtacatgaagtcagtcaactcctggtgcatggtggtaatggcattcctcgtgttggtgatcacgcagggtgctgccaccactaccgactactggcttagtttctggactaaccaggtggatggatacatacaaactctacccgaaggagaaagtccaaatcctgaattgaacactcaagttggtctgttaaccacgggacagtacctcattgtgcacggcagtgtagtactagccattataatattgacgcaagtcagaatactttccttcgtagtgatgactatgcgagcttcggaaaatcttcataacaccatttacgagaaattgatagtggctgtaatgagatttttcgataccaatccatcgggtcgtgtcttgaacagattctcaaaagatatgggtgcaatggatgagctgttgccgcgaagcatgttggagactgttcagatgtacctgtctctagccagtgtccttgtgctgaacgcgatagccttaccatggacgttgatacccaccacagtgttgatgtttatatttgtattcctattgaagtggtacattaacgctgctcaagctgtgaaacgattggaaggaactacaaagagtccagtgtttggaatgatcaactctactatatctggactctccaccataagaagctccaactctcaggaccgacttctaaactcatttgatgatgcacagaatctccatactagcgctttctacacgtttttgggtggttcaaccgcatttggtctgtacctggacaccctctgtttaatctacctcggaattatcatgtccatcttcattcttggtgatttcggtgagctgataccggttggtagcgtcggtctggccgtcagtcagtccatggtgctcaccatgatgttgcaaatggccgccaagttcactgccgacttcttgggacagatgacagccgtcgagagggtcctggagtacaccaagctacctaccgaagaaaacatggagactggaccgacaacgccaccaaagggctggccaagtgctggagaggtgacgttctcaaacgtgtacctcaagtattctcctgacgacccaccagtactgaaggacttgaactttgcaatcaagagtggatggaaggtcggagtagttggtagaactggtgctggcaagtcctcgttgatatcagctctgttccggctcagcgacattacaggcagcatcaaaattgatggcctggatactcaaggaattgccaagaagcttttgagatcaaaaatatcaataattccgcaagagccagtgttattctctgcctcgctgcgttacaatctggacccattcgacaactacaacgatgatgatatttggagagcattggaacaggtggaactaaaggagagcataccagccctcgattacaaagtgtcggaaggcggcaccaacttctcaatgggacaacgtcagctggtgtgcctggcgcgcgccatcctccgctcaaataaaattctcatcatggacgaagctaccgctaacgtcgatcctcagacggatgctttgatccagaaaacaattcgtaaacaatttgcaacgtgcaccgtgctcacgatcgcgcatcggctgaataccattatggattcagatcgggtactagtcatggaccagggagtggccgcggagttcgaccacccctacatcttgctgtccaaccccaacagcaagttctcctcaatggtgaaggaaacaggcgacaacatgtcccggatcttgttcgaagtagccaaaacaaaatatgaaagtgattccaaaaccgcttaa

SEQ ID NO: 175 - DNA, 4110 bp, Spodoptera frugiperda
atggagtccaaagtagtattaacggagaagaatcctcatgagaaagccaacgtgatctccaaattatttttaacgtggagtttcagtctctttaaaaaaggctacaagcaaggtctgtcgatcagcgatttgtggcaagcaaggagcggagatgcatcgggacgcctcggtgaccgtctcgaggaggcgtggaagatagaacaagaggaggcgaagaagaaaggcgctaagccttctttctcgaaagctattgttaggaccttctggttcgagtacatgatgattggtcttgtagtcggtgtacttttcatggtagtctggccactaattcctttcactctagcattattcatagaatacttctcaaaagagaagacaccagaatcctaccggcaagctcatatatacaacttcttgatgaacttattcagtacgctgtcagctctcatgctgaaccacaccaatttggctcaaggtcgaatcgggatgaggatacgaatagcttgttgttccttgatatacagaaagattttgaaactgaaccgcgctggattgaacaatactgaggctgggcaagtaatcaacttgatgtcgaatgacgtcaatcggttcgacttggtgacattattcctgaacttcatctggatcactcctattgtggtgccggtggtctgttacctcgtgtggcagcatgttggtattgcaaccctcgctgcactggcggtcgtgggcgtccaaactgttattgtgcaagtatatttgagccatctccaaggaaaacttcgcggtaaaatagcaaaacgaacggatcaacgagtgaaggtgatgagtgagctggtcgatggagttcaggtcattaaaatgtatgcttgggaggagcctttcgagaaactagtccacaaactgcgaaaaatggaagtcggctacgtcctgaggacatccttcgtcaaaggtttcaccaccgccctagccgtgttcaccgagcgattcattctcttctccgctgtcgccacattcgtcctcattggaggaaacatcagagctcaaattaccttctctttagtccagtactttaaccttatgcagatgatttgcaacatctttttgcctatgggacttgcgtacttggctgagactaaagtatccatcaaacgattggaggaattcttgctactcgaagaaaatgaaccagaaaaaattacagccaacatgattctcgattccaaatccttattatctgacggaacagagaaggagaagaaggttcaggagaaacaaagagtgactggtctgaccatttccaacgtgtctgcgagttggaccaacgattccgtagtggatacactaaggaatatcacaataaatgccgcacctggagaattcgttggtgttgcaggtggagttggttctggcaagtcttcgcttttgcaactgattcttggggagttgatgcctaaaagtggcactgtcaatttgggtggagctaaagtatcgtatgccagccaggagccctggctcttcgtggctactgtcagggagaacattctctttggcctgccatacgaccggattaggtacaagaaggtggttagagcttgtgctcttttgagggacttcgaactgctacctcatggagactctaccctggtgggagaaagaggcatcagtcttagtggtgggcaacgagcgagaattggactggcaagagcttgttatagaaaagcggacatctacctccttgacgaccccctatcagccgtggacacccatgtaggcaagcacatggtcaccgaatgtgtcatgggactgctagagaaatccactcgaatcctggtgacgcatcagcttcatcacctcaagggcgcagacaaagtcgttatcctgagacatggtgaagtagaaatccaaggttccttcgacgaagtatctcgcactccactatttgctgaactattacaagacgaggaggaagaagaggctgcaggcgaacacgtcaagatgcagagaagcatttctgtcaggtcacaagctagcagcatctctcctgcagaaggcattatcggtgaagatctgatcgaacaacaagtagaaatagaagaaattacaggcacaggtcgtgtcccaggaaaagtgtattccaaatacttcagcattggagccggttgttgcctcctgtcttccacagtgattgctattctgttcgctcaagtcatcacgtcggtcagcgacttgtggcttactcactggatgaacaacgttgaagctcaatacgtagcaaatgtgcctctgttccgagttgccaacgacaccataattccactaaatgatacactagtgaacgcaacggaatctgcagtgactgaaggaacaataactagtactattggagctatcactacagctttcctatctaatgacacgatggaaacaactgaagctatcctaaacgctactgtatttgatactactattgtggctccagctaaaatcaatgaccgctactacatttatatttgggccgctgctattgtcgggtgtatcattgccacttctggaagagccatgatgttcctgtgggtgtgcatgcgcagttccatcaagctccacaacgagatgttcaggaacattctgagtgccaccatgcggttcttcgacaccaacccctctggtcgtatcctcaacagattctccaaagacatgggcgtcgttgatgaaattctacctagaatgtatttggacactattcaggtgttcatggtgatgatgggtattctcgtgatggttgccatcgtgaacccctacatgttgatgacgactgcagtctgcgctatcgtcatgtacggcttgaccgtcgtctacctcagcacagcacaggctattaaacgagtggaaggtgtgtcccgtagcccagtgttctctcacgtgacggctactatgtctggtctaggcacggtgcgggcgtgtgaagcacaagaaatgctgaaggtacagtttgatgacaagcaggatgtgcacacagctgcatggtacttgacactggtcaccaacacagccttcgccatctggctgagtctttgctgcagcgcttacgttattgtggtcgcgtacaccttcctgttcttagatgacggtaacaccaagtccggtaacgtaggccttgccatcagccagggtctgattctcgtgaacatggtccaatacggagtcaagcaagctacagaggtgatctcacagatgacgtccgtagaaagagtgatgcagttcacatcactaccgcaggagaaaactgaaggacccaagccaccagcgaattggccgcagaaagctcgtgttgtgttcaaagacctcactcttcggtacgataaggacgctgatcccgtactgaagagacttaatgttactattgaaagtggatggaaggttggagtcgttggtcgtactggagctggtaaatcttctctaatctctgctctcttccgtctggcaccgattgaaggcaacgtctacattgacgatgtcgaaaccggcaaaatcgctcttaaagaattgcgttcaaagattgctatcattcctcaagaaccggtgctgttctccgcaagtctgcgatacaacatggatcccttcgacaaatactctgacattcagatttgggaagctttggaacaggtagaattgaagagcagcataacatctctgtcgtctccagtagcatcaggcggctctaacttcagcgcgggacagagacaactgttgtgtttggctcgagctgccctcgcacgcaacaagctcctcgttctagacgaggctactgccaacgttgaccctacaactgacgccatgatccagaagtctattcgcagacatttcgcggattgcaccgtgattacagtcgcacacagattgcatactgttgctgattccgatagagtagtggtaatggaagcaggtcaaatcatagagtgcggtcacccacacgaactactccaagacgaagaaggtcccttcacaaagatggtgaaacaactaggctctgcatccgaacagagtctgcgagaactagctagcaaagcatactccgagcacaacattaagaatgctatgaaagcttaa

SEQ ID NO: 176 - DNA, 4086 bp, Spodoptera frugiperda
atggactcgaaagtggtattgaaagaaaagaacccccacgacaaagcgaacttcatctcgaaaatatttctaacatggagctttagcctatttcgtcgtggatttaagcatggtctcactgtggaggacttgtggcaagcccgagccggcgaccactccggccgcctgggggaccgcctcgaacaagcgtggcaggaggaactcgacaatgccaagagaaaaggcatcaaaccttctttctcaaaggccatcgtacgatcattttggcttgaatatttaatgtgtggcctggttgtaggattactattcatctttttctggccattaattccatacacgttagctttattcataaattatttttccgaagataaaaccccagagagttatagaaatgcacacatttacaacttcctcatgaacttcctgagtatattgacggcattgatgctcaatcatttacaattaagccaaggacgagtaggaatgagagtgagaatagctagctgttcattattgtatagaaaaatattaaaactcgatagaactgggttgaacaaaacggagccaggacaggtgatcaacctgatgtctaacgatgtaaatcgttttgatttagtggctctgtttctgaactacttgtgggtgatgcctatcgtggtgccggtggtctcgtacctggtgtggcagcacgtcggctgggccactctcgctgcactcgtcgtcatattcgtacaaactgtactcgtccaagcctatttaagtaaccgccagggagtattacgaggaaaaattgctaaacggacagatgaaagagtaaaagttatgagtgaactagtaaacggtgtacaagtcatcaaaatgtatgcgtgggagaaaccttttgagaggttggtcgacaaactgcggaagatggaagtgagcttcataatgcgcacatctatgatcaaaggattctcgacggcgctgagcgtgttcacagagcgcttcatcttgttctcggctgtcgttgcgtttgtggtcatgggcggagacatccgcgccgagatcacattctccctcgtccagtatttcaatctactccaactcgcctgcaacatattcttcccactggccctcgcatttctggcagaaactaaagtctcagtgagacgccttgaggagttcttgttgttggacgaactgacacctgcgaagttaccgctagcaatcgattcgaaggaaataattagcaatggtactgagaaggaaaagccgaagcatacgggcttgatattgaatggactgagcgcgagctggcaaccagaggccattgtcaacacgttgaggaacatcacgctgactgcagaacctggagagtttgtgggcattgctggacttgtgggatctggaaagtcgacccttctgcaagtcatcttgggtgagttgcctccaacgcagggcaccatatcgttgggtggcgcgcgagtctcctacgccagccaggaaccttggctcttcgtggcaaccgttcgtcaaaatatactctttggacttccatacgatcgcatacgttacaaaaaggtcgtgagcgcatgcgcactgttgcgggacttcgagcagttgcctgcaggagactcgacactggttggagaacgaggcatcagtctgagtggaggacagcgcgcgcgcatcggactcgccagagcatgttatagacaggccgacatatacctgctggacgatcctctatcagcggtggacacgcacgtcggtaaacacctggtatcagaatgtgtgatgggattactgagacattctacgaggatcctggtcacacatcagctacaccatctcaagtctgctgataaggtcgtcatcctgcacaacggtgaaatagagactactggatcgtttgacgatgtgtcgcggtcgccactgtttgcggagctgctccaggaagaggaacaaccagaagatccgaaagtccagtaccttcgacaaagaactctttctatacagtctcatacaagtaccaacactttacaagatggggctgtggctgatgaggttgagcaggaggagtcggccgagctgatgggaacaggtcgtgtaccaggcgcggtgtatcgtcaatactttcgcgccggcgctggctggggcctcatcttatggacaacgttcagcattcttctggcacaagtcgttacctccatcagtgacctttggctgacacaatggatgaatgtcgtggaaataagacatggattggaaaacaaccaaacgactactcctctcttccataacatcacaaatggcaacaattctattggcagcaatgacaccattagcaatttcactacagagctgccgaccacgataccctcgtccacagaactgcccaacatgactgtcattgatacgatggtgaagactgtcctaactatgcagaatattacgtctgtctacgaaccaatcaaccacgactattatatttatatttgggcgattgctattctaggctgcatcatactcacgactggaagatcgattttgttcctgtgggtgtgcatgcgtagttcgataaagttgcacaaccagatgttcagcaatatactggcggccacaatgcgcttctttgacaccaacccttctggacgaatcctgaacaggttctctaaagacatgggagtggttgatgagatcctaccgaggatgtatttggacagtatacagatattcatggtaatgatgggtattcttgtgatggtagcgatagtcaacccctacatgttgctcacaacgggtgtctgtggtatccttatgtacatttggactgtgattttcctcagcactgcacaggctattaaaagggtggaaggtacgactcgcagtcccgtattctcacatgtttcggcaacgatggcaggactaaatacagtgcgtgcttgtcaagcgcaggacatgttgcgagatcaatttgacgacaagcaagacgtgcacacagctgcctggtacttaacgatcgtcacaaacactgcattctctatttggttaagtcttatctgtgcgacttatgtagtagtcgtagcctacacattcttgctcctggatgacgggactacaaaatcaggaaacgtcggattagcgattagtcaaggcttgatcctagtcaatatggtgcagtatggtgtgaaacaagcgacagaggtgatctcacagatgacaagcgtggagcgtgtagtgcagttcacatcgctaccacgtgaggtgacggacggccctgcaccacccaccggctggccccagcgcgcaaggctggtcttcaaggatctctcgttacgatatgacaaagatgccgatccagtgcttaaaaaacttaacattgttattgaaagcggatggaaagtgggagtagtcggtcgtacgggagctggcaaatcttcactgatatcagctctcttccgcttggcgcctattgaaggaaatgttttcattgatgatgttgataccggcaacatcgctctgaaggagctaagatcaaagatctcaatcattccgcaagaaccagtactcttctccgctagtttgcgttacaatatggatccattcgacaaatattctgacgctgatatttggacagcattagaacaggtggaattaaagcgaagtgtaacgtccttgtcatcagccgttcagtcaggcggttctaacttcagcgctggtcagagacaactgctctgcttggcgcgtgcggctctaggtcgtaacaagctacttgtgctcgacgaagctacagctaatgttgatccgaatacggatgcacttattcaaaaatcaattcgcacacatttcgcggattgcactgtgatcacggtggcacatcgactgcacactgtcgctgactccgacagagtcgttgtaatggaagctggtgagatagtggaatgtggtcatccacatgaactgctacaaaagcccgagggtcacttcactcgcatggtgcagcagttgggccctgctgcggaacagagtctgcgcgacttggcggcagccgcgcatgccgagcacatcaaatacgtcgacaccgacgataacaaccaataa

SEQ ID NO: 177 - DNA, 2064 bp, Spodoptera frugiperda
atgaccgccggcaacgaggagcatgagcctctgattacatcgtccgttgataaccagcgtgttgcttttaataactcgcctactggtggtcctactccagaatcgacgcctcgcggcagtggcggtgaaataaccttggcaataccagcgcaccgtaactatggagccattggagggatcgagaaggtcacttacacgtgggcggacatcaacgccttcgccacagagtccaggtcgagatccaggaggatctggaacttctggaagccgtccgccagtggaatgttccagcagaggaaacagctgttgagaaatgtcaatggcgcggcatacccaggcgagctccttgccatcatggggtcatcaggtgccggtaaaacgacactcctcaacacgctcaccttccgtactccaagcggggtgctgtccagcggtaccagagctctgaatggccagccagctactcctgaggcgttggcagcactgtcggcttacgttcagcaacaggacctgtttattggtacactcactgtcaaggagcatttgatattccaagctatggtgagaatggaccgacacataccatacgctcaacgcatgcgtcgtgtacaagaagtaatctctgagttggcgttaacaaaatgccagaatacggtgatcggtatccctggaaggttgaagggtatatcgggaggtgagatgaagaggctgtccttcgccagtgaggtcctcactgatcctccccttatgttctgtgacgaaccgacttcgggactcgactcgttcatggcgcagaatgtgttacaggtactcaaaggcctagcccagaagggtaagacagtggtatgcaccatccaccagccgtcttcagagctatacgccatgtttgacaagctgctgatcatggctgacggcaaggtcgctttcctcggctctccggaccaggctaacgatttcttcaaagaactaggagcagcctgtccaccgaactacaacccggcagaccacttcatccaactcctggctggagtaccaggcagagaggaaaccacccgtacgaccattgatactgtctgcacagcattcgcgcgatcagaggttggctgcaagatcgctgctgaagctgaaaatgctctatattttgaacgtaaaatctcgtccggctgggcagacccggcgtggtcggaagccacagcgatccgcgcgcgccggtccccgtacaaggcgtcgtggtgcgcgcagttccgcgccgtgctgtggcgctcctggctctccgtcaccaaggaacccatgctcatcaaagtgcgcttcctacagactattatggtatccattctgatcggcgttatctacttcgggcaacacttggaccaggacggcgtgatgaacatcaacggcgccatcttcatgttcctcaccaacatgaccttccagaacatcttcgctgttatcaacgtattctgttcagagctaccaatatttatacgggagcatcattcagggatgtatagagccgacgtgtacttcttgtctaagacgttagctgaagctcccgtgtttgcgaccataccactagtgttcactaccatagcgtattacatgatcggactgaatcccgaaccgaagcggttcttcatcgcttcgggattggctgccctcatcaccaatgttgctacttcgtttggttacctgatatcatgtgccagcaacagcgtcagcatggcggcgtccgtgggacctcccatcatcatccccttcatgctgttcggaggattcttcttgaacaccggctccgtaccaccatacctgggctggatatcgtacctgtcgtggttccactacggcaacgaggctctgctggtgaaccagtggtcgggcgtggagaccatcgcctgcacccgggagaacttcacctgccctgcttctggacaagtcgtcttggatactcttagtttctctgaggacgacttcacaatggacgtgatcaacatggttctcctgttcatagggttccggttcctcgcctacctggcgctgctgtaccgggcgcgccgggccaagtaa

SEQ ID NO: 178 - DNA, 4017 bp, Helicoverpa zea
atgggcgtagaaaataagaataatgtacaaaatgcggaaggtccggcccgcaagacttacaaaaaaccgaacattttatcccgtatatttctctggtggatgtgtcctgtgcttataactggtaacaaaagaaatgtagaagaatcagatcttataccgcccagtaatttatataattcagaaagacaaggagagtatcttgaaagatactggttggcagagatagaaaatgcaacaattgaaaatcgggagccatcactatggaaggcattacgaaaggcctactgggtctcctacatgccaggagctatttttatcatcattcaatctgcagccaggacgtatcagccgctgttgttttctcagttactgtcgtactggtcggtggacagtgaaatgactcagcaagacgctggcctctatgctctcgccatgctgggactgaacttcgtctccatgatgtgtcagcaccacaacacactgtttgtgatgcggttcagtttaaaagtcaaggttgcctgttcttcgcttttgtataggaagttgctccgcatgacccaagtgtcggtgggtgaggtggcaggaggaaagctggtgaacttgctgtccaacgatatcacgaggttcgactacgcgttcatgttcctacattacttgtggatcgtgcctatccaagtggctgttgttttgtatttcttgtgggaggctgctggcttcgcacccttcgtcggtctgtttggagtcgttatactgattttaccactgcaagctggcttgacgaaactcacaactgttgtaagacgtgagacggctaagagaacggacaggcgaattaaactaatgagtgaaattattggtggtattcaggtcattaaaatgtacgcttgggagaaacccttccagctagttgtgaaggcagctcgtgcctttgaaatgagtgccctcaggaagtccatcttcatcaggagtactttcctagggttcatgttgttcactgagcgaagcatcatgtttgtcacagtgttgacactcgctctcacaggcactatgattactgccactacgatataccctattcaacagtacttcagtattattcagtttaacgtaacactgatcattcctatggcaatcgcaagttattccgagatgatggtgtccatagaacgtatccagggattccttagtttggacgagcggtccgacatgcaagtgactccaaaaattaatggatctaacaataacactttgtttaaatccaagaagtcaccacttgaagtaggcatcgtgcctaagaaatactcacctagtgaagttatggctgcaaaggagatgcaggatgatcctacccagatggactatcctatcaggcttaacaaagtaagcgcatcgtggaccggcagcaatagttcttcagaaatgacacttaagaatatatcgttacgtattcgtaaaggaaaattgtgtgctatcattggtcctgtggggtccggaaagacatctctactgcaactgctcttaaaagaattaccattgaatagtggtacacttgacgtgagcgggaaaatgtcgtacgcttgtcaagagtcctggctgttcccaggcacagtacgagaaaacattttgttcggcctaacttacgaacccacaaaatacaaagaggtttgcaaggtgtgttcgttgctgcctgacttcaagcagttcccgtatggtgacctgtctttagtgggagaacgaggagtgtccctgtcaggtggtcaaagagccaggatcaatttggctagagcaatttatcgtgaggccgacatttacttgctggatgatcccctatctgcagtggacgctaatgtaggcagacaactgtttgatggctgcatcaaaggctacctcactggacgaacttgcgtcttggtcacccatcagatccattacctcaaagctgctgattttattgtagtccttaatgagggttccgtcgagaatatgggcacttatgatgagctggtgaagacaggaactgaattctcgatgctgctatccaaccaagaaaatgacgcaactgaaaacgaaaagaaagaccgaccagcaatgatgcgaggaatatcaaaaatctcagttaagagcgacaccgaaatggaacagaaggctcaaatacaggaggcagaggagagagcgacaggtagcttgaagtttgaggtggtgctcaagtacctgagctccgtccagtcctggtgtctggtgtttacggcgttccttgtactgctgatcacgcaaggtgctgccaccactgccgactattggttgagtttctggactaaccaagtggattcttatgaacaatctttacctgaaggcgtggatccagatactgacatgaacgcacaaattggcttacttacaactgcccagtacctatacgttttcggtggagttatattggctttaatagtcatgacccttgtcagaatcacagctttcgtagcgatgacaatgcgagcttctcaaaatcttcacaacactatttacgaaaaattaattgtgacagtaatgagatttttcgataccaatccttctggtcgtgtgctgaacagattctcaaaagacatgggtgccatggatgagcttcttcctcgcagtcttttagaaacagttcagatgtatttgtcgctgaccagtgtgttggtgctgaacgccactgcattgccctggacgcttatacctacctccgtgttgattgtcatcttcgtgctcatgttgagatggtacctgaatacagctcaggctgtcaaacgtttggagggcacaaccaagagtcctgtatttggaatgattaactccactatttctggactctccactattagaagttcgggttcccaggatagacagatgaaattgtttgacgaagcgcagaatctccacacaagtgctttccacacattcttcggcggttctacggcatttgcattgtatctcgatactttgtgtttgacctacctcggtgtcgtcatgtcaattttcattttgggcgactttggtgatttgatcccggtgggaagtgtcggtctggctgtcagtcagtccatggtgctgaccatgatgttgcagatggcagctaggttcacagctgactttttggggcaaatgacggctgtggagagagttctggaatacaccaagctacccacggagaccaatatggagcaaggaccaactaacccaccaaaggaatggcccagtgctggtagagtgacgttctcaaatgtgtacctgaattattccatggaagacccgccggtgctgaaggacttaaactttgaaattcaaagcggctggaaggttggagttgtaggcagaacaggagccggcaagtcatcgctcatcgcggctttgttccggcttagtgacataagcggcagcatcaaaattgacggtgtggacaccgaaggattagccaaaaagactttgagatcgaaaatatcaattattccacaagagccggtgctgttctcggctactctgcgatacaatttggacccgttcgacgattacagcgacgacgatatttggagggcgttggaacaggtggaattaaaagaaggaataccggctttagactttaaggtcgctgaaggtggtactaacttctctatgggacaacgtcagttggtttgcttggctcgtgccattctacgctctaacaaaatactcatcatggacgaagctaccgctaacgtcgatcctcagacggacgctttgatccaaaagacgatccgtcgtcagtttgcgtcgtgcacggtgctcaccatcgcgcatcgactgaacaccatcatggactccgaccgagtgctggtcatggaccagggcgaagtggccgagttcgaccatccccacatcttgctcagcaaccccaatagcaagttcttctctatggtccgagagacaggagaaagcatgacaaggaccttaatggaggtcgctaaggccaaatatgatagtgataataaggaagcttaa

SEQ ID NO: 179 - DNA, 4110 bp, Helicoverpa zea
  misc_feature (1167)..(1167): n is a, c, g, or t
atgggtacaaagaaagacgctaagaacgggacgggcgagaaaataccaccgcccccgccaccgccaaaacaaaaggatgtgccaaacacgtttttgaggacgttattttgctggatgctacctatattttattttggcaatcgaagggacttggagcagcatgatctgccaccaccaaaaaatatgtataattctaaagtggtaggagatagactggagagaaattggctaaatgaagaaagagaggcaaaaagcgaaggacggaagccaaagttcgtgagagttctagtaaggacatttttctggtctttcataccaggtggtttgatgcaatttacttcaatagctttaagaacggcgtctccattgctgttcagccagttacttcagtactggtcagtagactcgacgatggctcgagagacagccatgtactatgccctgggaatgatcctcgccaactggttgtcgtctttcatgaaccaccacggagcactgtactgccagcagttcggtatgaagataaggtgtgctgttggctctttaatgtttagaaagataatgcgtatgagcaacggttccctgggtgagacgacagcgggtaaagttgtgaacttgctgtcaaacgacctgcagagattcgacttggcgatgatgttccttcactatgtgtggatcatacctctgcaagtggccgcggtcatatacctcgggtacttgcaggtggggaccgctgccttcatcggcattgcggctttaatcctcattgttctgcctttccagggtggtatgggtcagtacttaggtaaacttcgacttcgtacagctgaaaaaacggacaacagaataaaaattatgagtgaagttattaatggaatacaggtgataaaaatgtatggatgggagattcctttccaaaatgtggtggggcagaagcgtgcagatgagttgaaagaggtgaaaagagctaccattgtgaggacagtgttcctcgggttcatgatgttcacggagagaactgcgctcttcctaactgtgctcacatacgtcttgcttggaaacgtcatgtcggcgaatgtcttctacccgctgcagcagttcatgaacgcggctcaagtgaacgttacattaatcttgccgctggtattgtctttcactgcagagctnttggtctctctgggaagggttgagaaatttctggcgttgcaggacaggcccgacttgacggggcagtcggaggaggtctcgtccaacttgttccgcaacatgtcggcgaaagataacttggacaacttggagatgaatggctccgtacgaccactctcgtaccatcgcaaatcggatggagcgcctatagggcctaccttaggggcagagctcaaaaagtctcctaacccgaagttcgcgaggagtgtgtcatatcaggacgacactgctttggtagtacacgatgtgtccgctagttggacaggggaccccaatgctttggccctcaagaacatttctatgagactgcgtaaaggaaaactttgtggtatcatcggcgctgttggctctggaaagtcctcgattctgcaacttctactaaaagaattgccctcggcgactggcagtgtttcaatatacggcaagatctcgtacgcttgccaagaggcgtggctgttccccagcaccgttcgggagaatatacttttcggtttgccttatgaacccgaaaaatataagaaggtatgccgcgtgtgtgcgctggagaaggacttcaagcagttcccgtacagcgaccagacgctggtcggggagaggggggtgtcgctctcaggaggccagcgagccagaatcaatttggcgcgcgctgtttacagagaagcagacatctatctattggacgatccgctgtccgctgtggacgcgaacgtgggtcgtcagctgttcgaaggctgcatcaacggctacctgcgcgggcgcacacggatacttgtcactcatcagatacacttcctcaaagctgccgactatatcgttgttttaaatgagggtcgtattgaaaacatgggaacatttgaagaactggtaaattctggcaaggaattctctatgatgctctcacaactgcaggaaggcaaggagaaggactctgacagtttaggatcacggagcattgaagagaaagataggcctgcactgaagaccatggccagcgtgacagaagaagatgacggggaggagtttgaagctcagaagatggaagaagaagagaggcagtcaggcaacctgcggtgggaggtgatcgccgcgtactttaaagctggagggaacgcctgtttcatattgtttgctctgtccatgatcgtgctgtctacgaccagcgcagcttctgttgactactgggtcagttattggacgaatcagatggctgtgtacgaggagtccttgggcggtgctgatatagatcccggcttggatgtgcaagtaggcatattcacgatagcccagtacttaataatccatggtgcacttgtggcgatgtgcatcgccataataaacctgcgagtgtttcccttcgcctacctctgcgtcaacgcgtccagtaacctgcataacaccatgttctccaccatgctgaaggggatcatgcgtttctttgacaccagctcatcaggtcgtatattgaatcggtttacaaaagacatgggtgctctcgacgaaatcttgccacggacactgttggacgtgcttcaaatctacggaaccctgactgctattctcgtcctgaacgccatagctctgtactggaccctgttaccctcagctgtgcttcttattttgttcatctttatggtccggatttatttgaaggcagcgcagggtataaaacgattggaaggaacagccaaaagtccaatgtttggtacagtgacgtcatcgctcagtggcatatctaccatcagatcagcaaatgcccagaagtggcttattgaacagtttgatacgaatcaggacttgcacaccacttcatggaacagctacttgaatggaggcaccacattcgggttctacttagacaccatgtgtttgatatacatgaccactgtcataggcgtcttcctgtttgttgatttcggcgacacgatccccgtgggcagtgtaggtctagcggtgacacagagcaatatgttgacgatcatgctgcagcacggagcgcgcatgttagtggagttcctcgcgcagctgaccagcgtcgagcgcattctgcagtacacacgcattgacacagaacctaacttgttccaaggaaaaatcgaaatgccctcatcatggccttctcaaggaaaaattgtctttcaaaatgtgtatctacgatatgcgccaaatgaacaacccgtattgaagaacctgaaccttgtcatagaaagtggacataaggtcggaatagtaggacgcacgggagctggcaaatcttccctgatatcagctctgttcagatttgcctacatcgacggattaatatcgattgacggactcgatacttcgctggtttcgcgccagggactgcgatcaaaaatttcaattataccgcaagaaccaatcctgttctctgctacaatccgatataacttggatccgtttgacatgtacagcgatgatgacctctggagagctctcgaacaggttgacctaaaatcggctatcccatcattagactttaacgtaaccgaaggtgggtctaatttctcagtgggccagcgacagttgatgtgcttggcgcgtgctgtactacgatccaatcagattttaataatggacgaagctaccgcgaacgtagatcctcagacggacagcttcatccaggaaacgatccgtcggcagttcgtgtcatgcaccgtgctgacgatcgctcatagactcaacactatcatggactcggacaaggtgctggtggtgagcagcggcgagatcgcggagtacgaccacccgtacgtgctgctgtccgaccccgacagccacttctccgccatggtgcgcgagaccggcgagaagaacagtgccaacttattccgaattgccaaagactgttattttcaaagcaatctgaaagaaaacgcaagataa

SEQ ID NO: 180 - protein, 1735 aa, Spodoptera frugiperda
MRLVPKQASPFAKFRLLMWKNFLQQWRHRTQTVLEILLPVLTMTLVLILRWQIEPAERETQTYPPFRANTLNFSTVVLFGLDCPNVSIAYSPTSPVLEDVVRNAITNLLIQNMEDLIARLPIEIELPPTIEINSTAILDWIKSRIRVQAYNNSHETRGIYIEEENTRRVIAVVEFDDKLYGAESLSNNLSYSLRFPERPRLNSLFQTGGRTWRTDAVFPVFETPGPRFSKSWEGGNDPGYVNEMFIALQQVISTELISRSTGVNMSEFTVFLQRYPHPPYIRDMALDLLQFMFPMFIMLSFSYTAINITRAVTVEKELQLKETMKIMGLPTWLHWTAWTCKQFVFLLVSASLTVILLKINWFTNEDGFSEYTVFTNTPWTVLMFFTMLYLTCVIFFSFMMSSFFSKASTAALCTVVVWFLTYIPAFLLAMDIEMSTTVQVFTCLSINSAMSYGFQLLLAKESTGGLQWGDFMSAPGTDSNRFVFGHVVIMLVVDCFVYMLVTLYFEQVMPGPFGTPKRWYFPFQLRFWFPHYKPGTVLVLENENSEFEDIIKEKEPNEHEVGVKMNNLTKIFGANTAVNNLSLNIYDDQITVLLGHNGAGKSTTISMLTGNLEVTRGTVTVAGYDMTHETYAARAHIGLCPQHNVLFNELTVREHLEFFARLKGFRGAELKSEIDTLIEKLELQDKRDYPSNGLSGGQKRRLCVGIALSGAARVVLLDEPTSGMDPSSRRALWELLQKEKKGRSMILTTHFMDEADILGDRVAIMAQGRLQCVGSPYFLKRHYGVGYTLVVVKDDDFDFEECTRLINKYIPDTVVKEDRGTEITYNLINDYSYAFEEMLNDLECNMEKIKYKNYGLTATTLEDVFMSVGSDLAPVNNSDNDDAVTTTTDSTIDDILKHELDSSLEELDRDESSVTGFRLLCQQVLAVWMKKGLTLIRSPWLMILQFFAPVILINATLGVMRYVMSLTPTIRSRFLSLTEGFTSTETLLSFNGTLGSSVGAIAAAAYEMIFTASDVENMGVTHIGNVPMDEYYLNRTMDPVVMGQLRHQILIGSTFDDNNATLWFSNFGYHDVAIALSTFHSAFLRAFNSTAQLNVYNHPLEATYRDQTDMQMMIAMLSMQLSSGIGSSVSIVSAVFIMFFIKERTSGAKLLQKAAGVQPAVLWGSAAVFNWAWFLITCVSIVITCAAFQVIGLSTAQELARMYLCVMLYGAAMLPLVYILSFAFNGPAVGFVGYYFMNVLFGMMGAQIVEALSSPQLNTAEAANILDYILQFFPLYSLITAVRFLNQVGLREYTCLQMCEYYQAVNPNLQCTMESLCSRYEECCVEPNVYFKWNQPGVSRYLTSMIISCIVFWTILMIIEYRVFQKLCTIKKTPPPLDESILDEDVQKEAQRARNVLPSQRYEHALIANDLSKYYGKHLAVNQISFGVNDGECFGLLGVNGAGKTTTFKMLMGDESISSGEAFVSGHSVEKSLGKVHQNIGYCPQFDALFGELTGRETLHMFAMMKGLRLRSAAPTAETLAHALGFLKHLDKRVNQYSGGTKRKLNTAIAFLGRTRLVFVDEPTTGVDPAAKRHVWRATRGVQRAGRGVVLTSHSMEECEALCSRLTIMVNGRFQCFGTPQHLKNKFSEGFTLIIKMKMEDRDNDTASINSSRSVVDTVKEYVTQNFQNPRIMEEYQGLLTYYLPDRSMAWSRMFGIMERAKRDLEIEDYSISQTTLEQIFLQFTKYQRQAFELL

SEQ ID NO: 181 - protein, 1359 aa, Spodoptera frugiperda
MDTKKGSKNDSKSKPPPPKPKSVPNVFKRTLFCWMLPIFYFGNRRDLEESDLPPPKNMYQSKMLGDKLERSWLKEEYEAKLAGRKPKFTKVLFKTFIWSYIPGGLMQATSIGLRTASPLLFSQLLRYWAADSPVDRKTAMYYAISMILANWASSFMNHHGVLFCQQFGMKLRCAVGSLMFRKIMRMSNGSLGDTAAGKVVNILSNDLQRFDLSMVFLHYVWIIPLQIAAVIYLGYLQAGTAAFIGFAALIIIALPFQGGLGQYLGKIRLRTAEKTDNRIKIMSEVINGIQVIKMYAWEIPFQKVVGQKRAEELKEVKIATILRTVFLGFMMFTERAALFFTVLTYVLLGNVMSANVFYPLQQFMSAAQVNITLILPMVLSFTAELLVSLGRVEKFLLLEDRPDLKGHPEETSSNLFRNMSADGIPETNGSIRPLSYHRKSEASPIEPGSEIQLKVPKFTRSVSYQEDSALVLHDVSASWTGDPNMMALKNISMRLRKGKLCAIIGAVGSGKSSILQLLLKELPSATGTISIYGKMSYACQEAWLFPSTVRENILFGLPFEPGKYKKVCRVCALEKDFKQFPYGDQTLVGERGVSLSGGQRARINLARAVYREADIYLLDDPLSAVDANVGRQLFEGCINGYLRGRTRILVTHQIHFLKAADYIVVLNEGRIENMGTFDELVSSGKEFSMMLAQLQEGKDKDTESVGSRSIEEKEKPTLKTMISVNEGEEVQEFEAQKMKEEERQSGNLRWEVISAYFRSGGHVCFILFALLVVVLATTCAASVDYWVSYWTNQMAAYEESLGGESIEPGLDVQAGRFTVGQYLIIHGCLVAALVLMVNLRVFPFAYLCVSASAKLHNQMFSTMLRGVMRFFDTSSSGRILNRFTKDMGSLDEILPRTLLDVLQIYGTLTAILVLNAIALYWTLVPSAVLLVLFGFMVRIYLKAAQGIKRLEGTTKSPMFGTVTSSLSGISTIRASNAQERLIEQFDINQDLHTTSWNSYLNGGTTFGFYLDTMCLVYMTTIIFVFLFIDFGDAIPVGSVGLAVTQSNTLTLMLQHGARMLVEFLAQLTSVERILEYTRIDTEPDLFQGKVEMPPNWPYQGRIEFQNVSLRYAPNEQPVLKNLNIVIESGNKIGIVGRTGAGKSSLISALFRFAYLDGLISIDGLDTSLISRQGLRSKISIIPQEPILFSATIRYNLDPFDIYSDDDLWRALEQVDLKSAVPSLDFKVTEGGSNFSVGQRQLMCLARAVLRSNQILIMDEATANVDPQTDNFIQETIRRQFVSCTVLTIAHRLNTIMDSDKVLVMSSGQVAEYDHPYVLLSDPNSHFSAMVRETGEKNSANLFQVAKDAYFQSNLKENAR

SEQ ID NO: 182 - protein, 1363 aa, Spodoptera frugiperda
VNTKMDTKKGSKNDSKSKPPPPKPKSVPNVFKRTLFCWMLPIFYFGNRRDLEESDLPPPKNMYQSKMLGDKLERSWLKEEHEAKLAGRKPKFTKVLFKTFIWSYIPGGLMQATSIGLRTASPLLFSQLLRYWAADSPVDRETAMYYAISMILANWASSFMNHHGVLFCQQFGMKLRCAVGSLMFRKIMRMSNGSLGDTAAGKVVNILSNDLQRFDLSMVFLHYVWIIPLQIAAVIYLGYLQAGTAAFIGFAALIIIALPFQGGLGQYLGKIRLRTAEKTDNRIKIMSEVINGIQVIKMYAWEIPFQKVVGQKRAEELKEVKIATILRTVFLGFMMFTERAALFFTVLTYVLLGNVMSANVFYPLQQFMSAAQVNITLILPMVLSFTAELFVSLGRVEKFLLLEDRPDLKGHPEETSSNLFRNMSADGIPETNGSIRPLSYHRKSEALPIEPGSEIQLKVPKFTRSVSYQEDSALVLHDVSASWTGDPNMMALKNISMRLRKGKLCAIIGAVGSGKSSILQLLLKELPSATGTISIYGKMSYACQEAWLFPSTVRENILFGLPFEPGKYKKVCRVCALEKDFKQFPYGDQTLVGERGVSLSGGQRARINLARAVYREADIYLLDDPLSAVDANVGRQLFEGCINGYLRGRTRILVTHQIHFLKAADYIVVLNEGRIENMGTFDELVSSGKEFSMMLAQLQEGKDKDTESVGSRSIEEKEKPALKTMISVNEGEEVQEFEAQKMKEEERQSGNLRWEVISAYFRSGGHVCFILFALLVVVLATTCAASVDYWVSYWTNQMAAYEESLGGESIEPGLDVQAGRFTVGQYLIIHGCLVAALVLMVNLRVFPFAYLCVSASAKLHNQMFSTMLRGVMRFFDTSSSGRILNRFTKDMGSLDEILPRTLLDVLQIYGTLTAILVLNAIALYWTLVPSAVLLVLFGFMVRIYLKAAQGIKRLEGTTKSPMFGTVTSSLSGISTIRASNAQERLIEQFDINQDLHTTSWNSYLNGGTTFGFYLDTMCLVYMTTIIFVFLFIDFGDAIPVGSVGLAVTQSNTLTLMLQHGARMLVEFLAQLTSVERILEYTRIDTEPDLFQGKVEMPPNWPYQGRIEFQNVSLRYAPNEQPVLKNLNIVIESGNKIGIVGRTGAGKSSLISALFRFAYLDGLISIDGLDTSLISRQGLRSKISIIPQEPILFSATIRYNLDPFDIYSDDDLWRALEQVDLKSAVPSLDFKVTEGGSNFSVGQRQLMCLARAVLRSNQILIMDEATANVDPQTDNFIQETIRRQFVSCTVLTIAHRLNTIMDSDKVLVMSSGQVAEYDHPYVLLSDPNSHFSAMVRETGEKNSANLFQVAKDAYFQSNLKENAR

SEQ ID NO: 183 - protein, 1346 aa, Spodoptera frugiperda
MMDKSNKNTASNGTAVGEPKERVRKKPNILSRIFVWWIFPVLITGNKRDVEEDDLIVPSKKFNSERQGEYFERYWFEEVAIAEREDRDPSLWKAMRRAYWLQYMPGAIFVLLISGLRTAQPLLFSQLLSYWSVDSEMSQQDAGLYALAMLGINFITMMCTHHNNLFVMRFSMKVKIAASSLLFRKLLRMSQVSVGDVAGGKLVNLLSNDVARFDYAFMFLHYLWVVPLQVGVVLYFVYDAAGWAPYVGLFGVIILIMPLQAGLTKLTGVVRRMTAKRTDKRIKLMSEIINGIQVIKMYAWEKPFQLVVKAARAYEMSALRKSIFIRSMFLGFMLFTERSVMFLTVLTLALTGNMISATLIYPIQQYFGIITMNVTLILPMAFASFSEMLISLERIQGFLLLDERSDIQITPKVVNGAGSKLFNNSKKEGGLETGIVLPTKYSPTEANIARPMQDEPNMADYPVQLNKVNATWADLNDNKEMTLKNISLRVRKNKLCAVIGPVGSGKTSLLQLLLRELPVTSGNLSISGTVSYASQEPWLFPATVRENILFGLEYNVAKYKEVCKVCSLLPDFKQFPYGDLSLVGERGVSLSGGQRARINLARAVYREADIYLLDDPLSAVDANVGRQLFDGCIKGYLSGKTCILVTHQIHYLKAADFIVVLNEGSVENMGSYDELMKTGTEFSMLLSDQASEGSDTDKKERPAMMRGISKMSVKSDDEEGEEKVQVLEAEERQSGSLKWDVLGRYMKSVNSWCMVVMAFLVLVITQGAATTTDYWLSFWTNQVDGYIQTLPEGESPNPELNTQVGLLTTGQYLIVHGSVVLAIIILTQVRILSFVVMTMRASENLHNTIYEKLIVAVMRFFDTNPSGRVLNRFSKDMGAMDELLPRSMLETVQMYLSLASVLVLNAIALPWTLIPTTVLMFIFVFLLKWYINAAQAVKRLEGTTKSPVFGMINSTISGLSTIRSSNSQDRLLNSFDDAQNLHTSAFYTFLGGSTAFGLYLDTLCLIYLGIIMSIFILGDFGELIPVGSVGLAVSQSMVLTMMLQMAAKFTADFLGQMTAVERVLEYTKLPTEENMETGPTTPPKGWPSAGEVTFSNVYLKYSPDDPPVLKDLNFAIKSGWKVGVVGRTGAGKSSLISALFRLSDITGSIKIDGLDTQGIAKKLLRSKISIIPQEPVLFSASLRYNLDPFDNYNDDDIWRALEQVELKESIPALDYKVSEGGTNFSMGQRQLVCLARAILRSNKILIMDEATANVDPQTDALIQKTIRKQFATCTVLTIAHRLNTIMDSDRVLVMDQGVAAEFDHPYILLSNPNSKFSSMVKETGDNMSRILFEVAKTKYESDSKTA

SEQ ID NO: 184 - protein, 1346 aa, Spodoptera frugiperda; identical to SEQ ID NO: 183

SEQ ID NO: 185 - protein, 746 aa, Spodoptera frugiperda
MMDKSNKNTASNGTAVGEPKERVRKKPNILSRIFVWWIFPVLITGNKRDVEEDDLIVPSKKFNSERQGEYFERYWFEEVAIAEREDRDPSLWKAMRRAYWLQYMPGAIFVLLISGLRTAQPLLFSQLLSYWSVDSEMSQQDAGLYALAMLGINFITMMCTHHNNLFVMRFSMKVKIAASSLLFRKLLRMSQVSVGDVAGGKLVNLLSNDVARFDYAFMFLHYLWVVPLQVGVVLYFVYDAAGWAPYVGLFGVIILIMPLQAGLTKLTGVVRRMTAKRTDKRIKLMSEIINGIQVIKMYAWEKPFQLVVKAARAYEMSALRKSIFIRSMFLGFMLFTERSVMFLTVLTLALTGNMISATLIYPIQQYFGIITMNVTLILPMAFASFSEMLISLERIQGFLLLDERSDIQITPKVVNGAGSKLFNNSKKEGGLETGIVLPTKYSPTEANIARPMQDEPNMADYPVQLNKVNATWADLNDNKEMTLKNISLRVRKNKLCAVIGPVGSGKTSLLQLLLRELPVTSGNLSISGTVSYASQEPWLFPATVRENILFGLEYNVAKYKEVCKVCSLLPDFKQFPYGDLSLVGERGVSLSGGQRARINLARAVYREADIYLLDDPLSAVDANVGRQLFDGCIKGYLSGKTCILVTHQIHYLKAADFIVVLNEGSVENMGSYDELMKTGTEFSMLLSDQASEGSDTDKKERPAMMRGISKMSVKSDDEEGEEKVQVLEAEERQSGSLKWAMCLGGT

SEQ ID NO: 186 - protein, 1349 aa, Spodoptera frugiperda
MMDKSNKNTAANGNGGQRAGEPKERVRKKPNILSRIFVWWIFPVLITGNKRDVEEDDLIVPSKKFNSERQGEYFERYWFEEVAIAEREDRDPSLWKAMRRAYWLQYMPGAIFVLLISGLRTAQPLLFSQLLSYWSVDSEMSQQDAGLYALAMLGINFITMMCTHHNNLFVMRFSMKVKIAASSLLFRKLLRMSQVSVGDVAGGKLVNLLSNDVARFDYAFMFLHYLWVVPLQVGVVLYFVYDAAGWAPYVGLFGVIILIMPLQAGLTKLTGVVRRMTAKRTDKRIKLMSEIINGIQVIKMYAWEKPFQLVVKAARAYEMSALRKSIFIRSMFLGFMLFTERSVMFLTVLTLALTGNMISATLIYPIQQYFGIITMNVTLILPMAFASFSEMLISLERIQGFLLLDERSDIQITPKVVNGAGSKLFNNSKKEGGLETGIVLPTKYSPTEANIARPMQDEPNMADYPVQLNKVNATWADLNDNKEMTLKNISLRVRKNKLCAVIGPVGSGKTSLLQLLLRELPVTSGNLSISGTVSYASQEPWLFPATVRENILFGLEYNVAKYKEVCKVCSLLPDFKQFPYGDLSLVGERGVSLSGGQRARINLARAVYREADIYLLDDPLSAVDANVGRQLFDGCIKGYLSGKTCILVTHQIHYLKAADFIVVLNEGSVENMGSYDELMKTGTEFSMLLSDQASEGSDTDKKERPAMMRGISKMSVKSDDEEGEEKVQVLEAEERQSGSLKWDVLGRYMKSVNSWCMVVMAFLVLVITQGAATTTDYWLSFWTNQVDGYIQTLPEGESPNPELNTQVGLLTTGQYLIVHGSVVLAIIILTQVRILSFVVMTMRASENLHNTIYEKLIVAVMRFFDTNPSGRVLNRFSKDMGAMDELLPRSMLETVQMYLSLASVLVLNAIALPWTLIPTTVLMFIFVFLLKWYINAAQAVKRLEGTTKSPVFGMINSTISGLSTIRSSNSQDRLLNSFDDAQNLHTSAFYTFLGGSTAFGLYLDTLCLIYLGIIMSIFILGDFGELIPVGSVGLAVSQSMVLTMMLQMAAKFTADFLGQMTAVERVLEYTKLPTEENMETGPTTPPKGWPSAGEVTFSNVYLKYSPDDPPVLKDLNFAIKSGWKVGVVGRTGAGKSSLISALFRLSDITGSIKIDGLDTQGIAKKLLRSKISIIPQEPVLFSASLRYNLDPFDNYNDEDIWRALEQVELKESIPALDYKVSEGGTNFSMGQRQLVCLARAILRSNKILIMDEATANVDPQTDALIQKTIRKQFATCTVLTIAHRLNTIMDSDRVLVMDQGVAAEFDHPYILLSNPNSKFSSMVKETGDNMSRILFEVAKTKYESDSKTA

SEQ ID NO: 187 - protein, 1743 aa, Chrysodeixis includens
MKMRREAKPAGAFMKFRLLMWKNFLQQWRHRLQTVTELLLPVLTMTLVLVLRWQMEPSMVGTLTYPPIPAHTLNYSTAILAGMNLTQMSIAYSPRSPVLDDVVRTGITNLLVANAKDLLPIFENISIPGLPEIELPSIPEDFNSTLIVEFLKSRIKIEAYNNSHDLRGLYIREESTRVVIAGIEFDDKLYDAESLSNNLSFALRFPERPRMNSFFQRGGRTWRTDIVFPLFEMPGPRYPWSWEGGRDPGYVNEMFIALQNAISNELISRATGEDLKKFRVNVQRFPHPPYILDMAVDLLQFMFPMFIMLSFSYTAVNIARAVTVEKELQLKETMKIMGLPTWLHWTAWFCKQFLYLLITAILIIVLLKIHWFTNEEGFSEYAVFTNTPWTVLFFFMVLYLSCAIFFCFMISSFFSKGSTAALCMGVVWFLSYVPAVLLAMDIDMSTAMQVFTCLSINSAMSYGFQLLLAKEAVGGLQWGDFMSSPAAETNRFVFGHVVIMLVVDCVLYMLVTLYLEQVMPGPFGTPKPWYFPFQMKFWFPNYSSDVGFILENEVSESEDIIKEKDPIDHTIGVKMHDLTKIYGNNVAVNHLSLNIYNDQITVLLGHNGAGKSTTISMLTGNLKATRGSMSVAGYDMSSQAAAARAHIGLCPQHNVLFNELTVKEHLQFFARLKGFKGQQLKDEIDTLIAKLELEEKRDYPSKGLSGGQKRRLCVGIALSGAARVVLLDEPTSGMDPASRRALWDLLQREKKGRSMILTTHFMDEADILGDRVAIMANGRLQCVGSPYFLKRHYGVGYTLVVVKDDDFDFEECSKLIHKYVPGSIMKEDRGSEIAYSLDNDYSHTFENMLNDLEKNIGTIKLKNYGLVATTLEDVFMSVGADLAPVQSESDDTATTTTDSSMDDILKHEIDSSLEQLDRDESSVKGFSLLYQHVLAVWMKLALVWIRSWWLVLLQFAAPVVLINATLGVLQYVMSFAPIITSRVLDLTEGYVLTETLLSYNGSSSTSLGALAAQAYETMFKTSGVNSMELTLIGSRPVEDYYLERANDTVAMANLRHRLLIGSTFDENSATAWFSNFGYHDVATSLATVYSAILKAKNSTAFMNVYNHPLEATYSDQSDLQTMIAMLSMQLASGIGSSVGIVSAVFIMFYIKERVSGAKLLQKAAGVQPAVLWGAAAVFDWTCFLLTCISIVISCAAFQVIGLSTASELGRMYLCAMVYGAAMLPFSYIMSHVFRGPAVGFVSFFFMNVIFGMMGPQVVEALSSPTLTTQHVAHIMDNVLQFFPLYSLVTSVRYLNQIGLREYTCLQSCEYLQAVYPNVECTMASMCEFSSNCCVRDNPYFDWEEPGVLRYLVAMTGTCAVLWTILMVIEYRLFQKVLRFRKTPPPVDESSLDEDVAREAESARHTHYADRANHALLATDLAKYYGKHLAVDQVSFSVSDGECFGLLGVNGAGKTTTFKMLMGDESISSGEAYVSGHSVRKNLNRVHENIGYCPQFDALFGELTGRETLRMFALMRGLRLSTAAPAVETLSHALGFLRHLDKRVDQYSGGTKRKLNTAIAFLGKTRLVFVDEPTTGVDPAAKRHVWRATRGVQRAGRGVVLTSHSMEECEALCSRLTIMVNGRFQCLGTPQHLKNKFSEGFTLTIKMKMEDNPETSSNSSAISKVDLVKEYVEANFQTPRIMEEYQGLLTYYLPDRTMAWSRMFGIMERAKRDLEIEDYSISQTTLEQIFLQFTKYQRQEGDES

SEQ ID NO: 188 - protein, 1749 aa, Ostrinia nubilalis
MNRKRESGRAAGSWMKFRLLMWKNFLQQWRHPIQTIVEVLLPVITMSLVLLLRWQIEPTAEDAINFSPLPAQSLNNSIQIFAGLNVTNFSIAYSPRSEALEDVLRSSMANLLLNNAFDLIRIITDLWPAEPPFPLPANITWPETPPVTLPPDLDWPDLEGVNKTLIYEFLRTLIRVQPYNSSVDLRTIYAYEERTKQVIAAVEFDDSLFGATDLPGSISYSLRFPERPRLNALFGRGGRSWRTDELFPAFELPGPRSRSSDGGSNPGYVREMFIALQQVISTQLITRITGEPMESFSVNIQRYPHPAYVDDMAVEALQFLFPMFIMLTFSYTAVNITRAITVEKELQLKETLKIMGLPTWIHWTAWFCKQFLFLLVAAVLIMILLKVNWFTNEDGFSDYAVFTNTPWSVLLFYLTLYLACVIFFCFMLSGIFSKGSTAALFAGVVWFLTYVPAFILSIDIAMSVPMQIFTCLSINSAMSYGFQLLLGRESTGGMQWGEFMSAPVTETDRLLFGHVVIMLVVDSVLYMLIALYLEQVLPGPYGTPRPWYFLFQKQFWGCGTKSASDSVLLNVAETPDVIKENDPVGHPVGVKMNNLTKVFGKNTAVNNLSLNIYDDQITVLLGHNGAGKSTTISMLTGNLEATYGTVWVAGYDMTWNTSDARSHIGLCPQHNVLFNELTVREHLEFFARLKGFQGEELNNEIDTLIEKLELTEKRDYQSKGLSGGQKRRLCVGVALCGDARVVLLDEPTSGMDPSSRRALWDLLQKEKKGRSMILTTHFMDEADILGDRIAIMASGQLQCVGSPYFLKRHYGVGYTLVIVKDVDFQLEACTEILSKYIPGTTVKEDRGTEVTYNLTNGRSQIFETMLLDLEKNMQQIKFKNYGLVATTLEDVFMSVGSDVSSTQSESDEVETATESSYYDFDSSSMDNLTQEQSISGFRLLVQHVLAVWLKLSLVWIRSWGLILLQILVPVLQMTATLGVMEYIFSLIPTIQRRALSFAVGYSQTESLLSFIGNSTSSLGALATAAYETMINSSVVDTMSLTMVNEPIDEYYMERAEQGGVGPLRHTVLAGATFTDDSVTAWFSNFGYHDIATSLAAVHTALIKAKNASYEINVFNHPLEVNYADQSDLQMRVTMLAMQLASGIGSSLGIASAVFVMFYIKERVSRAKLLQKAAGIQPAVLWGSAAVFDWLWFLVVCVTIVIICAAFDVMGLSSVDELGRLYLCLMVYGAAMVPLNYLSSLLFQGPALGFVVIFFINVLFGNMGAQIVDALSSPQLNTAEAARILDYILQFFPLYSLVTSVRLLNQFGMLESSCLQSCGYLQNIMNIPECNMTVMCDLYEECCIPADPYWAWDGGIMRYVTVMLITCLVLWGILMIIEYDVIKKIIRREKKPPQVDESTLDEDVLDEEKHVARIGSDLSQHSLVARGLSKYYGKHLAVNQVSFSVSDSECFGLLGVNGAGKTTTFKMLMGDETVSSGDAFVSGHSVRKDITRVHENIGYCPQFDAVFGELTGRETLLLFSLLRGLSASRADARTHALAHALGFTKHLNKRVNQYSGGNKRKLSTAVALLGRTRLVFVDEPTTGVDPAAKRQVWRAIRGAQRSGRGVVLTSHSMEECEALCSRLTIMVNGRFQCLGTPQHLKNKFSEGFTLTIKMRQEEEQASTSSCIVQRPVDTVKQFVESNFTNPKLMEEYQGLLTYYLPDRSIAWSRMFGIMEQAKRDLQVEDYSISQTTLEQIFLQFTKYQQEAAIQ

SEQ ID NO: 189 - protein, 1749 aa, Ostrinia nubilalis
MNRKRGSGRAAGSWMKFRLLMWKNFLQQWRHPIQTIVEVLLPVITMSLVLLLRWQIEPTAEDAINFSPLPAQSLNNSIQIFAGLNVTNLSIAYSPRSEALEDVLRSSMANLLLNNAFDLIRIITDLWPAEPPFPLPANITWPETPPVTLPPDLDWPDLEGVNKTLIYEFLRTLIRVQPYNSSVDLRTIYAYEERTKQVIAAVEFDDSLFDATDLPGSISYSLRFPERPRLNALFGRGGRSWRTDELFPAFELPGPRSRSSDGGSNPGYVREMFIALQQVISTQLITRITGEPMESFSVNIQRYPHPAYVDDMAVEALQFLFPMFIMLTFSYTAVNITRAITVEKELQLKETLKIMGLPTWIHWTAWFCKQFLFLLVAAVLIMILLKVNWFTNEDGFSDYAIFTNTPWSVLLFYLTLYLACVIFFCFMLSGIFSKGSTAALFAGVVWFLTYVPAFILSIDIAMSVPMQIFTCLSINSAMSYGFQLLLGRESTGGMQWGEFMSAPVTETDRLLFGHVVIMLVVDSVLYMLIALYLEQVLPGPYGTPRPWYFLFQKQFWGCGTKSASDSVLLNVPETPDVIKENDPVGHPVGVKMNNLTKVFGKNTAVNNLSLNIYDDQITVLLGHNGAGKSTTISMLTGNLEATYGTVWVAGYDMTWNTSDARSHIGLCPQHNVLFNELTVREHLEFFARLKGFQGEELNNEIDTLIEKLELTEKRDYQSKGLSGGQKRRLCVGVALCGDARVVLLDEPTSGMDPSSRRALWDLLQKEKKGRSMILTTHFMDEADILGDRIAIMASGQLQCVGSPYFLKRHYGVGYTLVIVKDVDFQLEACTEILSKYIPGTTVKEDRGTEVTYNLTNGRSQIFETMLLDLETNMQRIKFKNYGLVATTLEDVFMSVGSDVSSTQSESDEVETATESSYYDFDSSSMDNLTQEQSISGFRLLVQHVLAVWLKLSLVWIRSWGLILLQILVPVLQMTATLGVMEYIFSLIPTIQRRALSFAVGYSQTESLLSFIGNSTSSLGALATAAYEMMINSSVVDTMSITMVNEPIDEYYMERAEQGGVGPLRHTVLSGATFTDDSVTAWFSNFGYHDIATSLAAVHTALIKAKNASYEINVFNHPLEVNYADQSDLQMRVTMLAMQLASGIGSSLGIASAVFVMFYIKERVSRAKLLQKAAGIQPAVLWGSAAVFDWLWFLVVCVTIVIICAAFDVMGLSSVDELGRLYLCLMVYGAAMVPLNYLSSLLFQGPALGFVVIFFINVLFGLMGAQIVDALSSPQLNTAEAARILDYILQFFPLYSLVTSVRLLNQFGMLESSCLQSCGYLQNIMNIPECNMTVMCDLYEECCIPADPYWAWDGGIMRYVTVMLITCLVLWGILMIIEYDVIKKIIRREKKPPQVDESTLDEDVLDEEKHVARIGSDLSQHSLVARGLSKYYGKHLAVNQVSFSVSDSECFGLLGVNGAGKTTTFKMLMGDETVSSGDAFVSGHSVRKDITRVHENIGYCPQFDAVFGELTGRETLLLFSLLRGLSASRADARTHALAHALGFTKHLDKRVNQYSGGNKRKLSTAVALLGRTRLVFVDEPTTGVDPAAKRQVWRAIRGAQRSGRGVVLTSHSMEECEALCSRLTIMVNGRFQCLGTPQHLKNKFSEGFTLTIKMRQEEEQASTSSCIVQRPVDTVKQFVESNFTNPKLMEEYQGLLTYYLPDRSIAWSRMFGIMEQAKRDLQVEDYSISQTTLEQIFLQFTKYQQEAAIQ

SEQ ID NO: 190 - protein, 1328 aa, Ostrinia nubilalis
MLPIYYNGTKRDLEEYDLVPAKRQYDSKRVGDVLERYWLNEEAAAKAAGKKPSLLKTFAKAFGLSFISAGIMQFLSVGIRTFTPLLFAQLLQYWSVGSTMSKETAAMYAGGMILANWASAFLNHHGNLAAQQFGMKLRISASSLMFRKIMRMDNSSLGDTTAGKVVNILSNDMQRFDLALLFLHYIWIIPIQLAVVCYLGYLQAGYAALVGLASLVIIALPIQGYVGQKTGKVRFRTAEKTDERIKVMSEVISGIQVIKMYAWEIPFQKVVSEKRANELKEIRVASYLRIVFLGFMLFTERSALFITILVFILFGNTMSANVIYPLQQFMSAAQINITLILPLVLAFTAELFVTIGRIQDFLQAEDRPDLAKNPQSAAPMQNLFNKLSAEGALEKGDDHVRPLSYHRKSEAKITETPPVNVKPRKSVSLPGDIAVELRNVSASWTNDPTMSALSNVSLRLRRGKLCAVIGAVGSGKSSILQMLLKELPPYSGTVSVNGTVSYASQEAWLFPSTVRENILFGLAFDPEKYKRVCRACCLEKDFKQFPYGDQTLVGERGVSLSGGQRARINLARSVYRESDIYLLDDPLSAVDANVGRLLFEGCINGYLRGRTRILVTHQIHFLKAADYIVVLNEGQVENMGTFDELVESGKEFATLLASLQEGKDKDADSVGSGVSIEDKEKRDFKRMISTASTNENDDIEEFKAQTQEAEERQSGNLKWSVVSAYFSSGGNICFIAFTVTMILLAAVAAGATDYWISFWSNNMARYEESLEGGVPESGLDVQVGLFTTGQYLIIHGCLVITLVLLTHLRIFPFVALVVTASKNLHDFMFSTMIKGIMRFFDTSSSGRILNRFTKDMGALDEILPRTLLDVVQIYSTLLVILILNAIALYWTLIPSFVLLICFMFMVRIYMKTAQSIKRLEGITKSPVFGMVTSSLNGIATIRSAGAEKRLIDDFDNHQDLHTASWNGYLCGGSSFGLYLDTVCLIYLTTVIFIFIYIDFGDLIAVGSVGIAVTQTNALTAMLQHGARMLVEFIAQLTSVERVLDYTRIETESNLFEGQIESIPTWPSEGRIVFDNVNMRYSPTEEPVLKDLNITVESGWKVGIVGRTGAGKSSLISALFRFAYLDGKVTIDGVDTSLVAKQELRSKISIIPQEPVLFSATIRYNLDPFNLYSDAQIWQALEQVDMKSAVPSLDFKVTEGGSNFSVGQRQLMCLARAVLRSNKILIMDEATANVDPQTDNYIQQTIKEHFASCTVLTIAHRLNTIMESDRVLVMSFGRVLEFEHPYILLSDPNSHFSSMVKETGEKNAALLFQVAKDAYFQSNLKENAR

SEQ ID NO: 191 - protein, 1762 aa, Helicoverpa zea
VTIYAHYIDTQNKQEEDDTEMRLETRHASAATKFRLLMWKNFLQQWRHRLQTVVELLLPVVTMALVLILRWQIPPYQIDTLTYPALPAHTLNYSTNILFAMNMEELSIAYSPASPVLDDVMRTAVINLLTANMKDLIPIFIDNLPPGIANITFPPDMNLNTSAIEEFVKSRIRVVPYNSSYEIRGIYVDEETTRSIIAAVEFDDKLYGAEQLSNNLSYSLRFPERPRLNSFFQTGGRTWRSDGVFPVFEVPGPRFPHSWEGGNDPGYVNEMFVALQQVISMELVSRATGLDLKSFRVNIQRYPHPPYLHDQSVDLLQFMFPLFIMLSFSYTAVNIARAVTVEKELQLKETMKIMGLPTWLHWTAWFVKQFIYLSITAVLLVVLLKVNWFTNDDGFSEYAVFTNTPWTVLLFFLILYLSCAIFFSFMVSSIFSKGSTAALFMAVAWFLTYIPAFLLAMDINMSTAVQVITCFSINSAMSYGFQLMLAKESTGGLQWGDFMTSPGTDTTRFVFGHVVIMLVVDCLIYMLITLYLEQVLPGPFGTPKPWYFPFQLQFWFPNYKSKDAGLIFENDNSEFDDIIKEKDPTDHEVGVKMQNLTKIFGNNIAVNNLSLNIYDDQITVLLGHNGAGKSTTISMLTGNLKVTRGTVNVAGYDMTSQSSAARSHIGLCPQHNILFNELTVKEHLEFFARLKGFKGKELYEEIDSLIEKLELQEKRDYPSKGLSGGQKRRLCVGIALSGAARVVLLDEPTSGMDPSSRRALWELLQKEKKGRSMILTTHFMDEADILGDRVAIMANGRLQCVGSPYFLKRHYGVGYTLVIVKDTDFDFVKCSVLINSYIPGTIVKEDRGTEITYNLVNDYSHVFEEMLNDLERNIDNIKFKNYGLVATTLEDVFMSVGADLSPINSESDDAITTTTDSTIDDILKQEIDSSLEELDKDESNVTGLRLFGQQVLAVWMKQWLVLIRSPWVMVLQFLAPVVLINSTLGVLRYVMSLSPTIRTRWLSLEEGYTESETLLSFNGSVASSVGALAAQAYQSLFANSGVMDMEINAIGSQPIEEYYLNRTSDPVVMGSLRHRLLIGSTFDDNSATAWFSNFGYHDVATSLAAIHSAILRSKNSDAVLNVYNHPLEASYIDQSDVQTMIAMLSMQLSSGIGSSVSIVSAVFIMFYIKERMSGAKLLQNAAGVAPSVLWGGAAIFNWFWFLITCVSIVISCVAFDVIGLSNVHELGRMFLCVMVYGAAMLPLVYLLSLKFKGPAVGFVGFYFLNVLFGMMGAQVVEALSSPMLDTEQAAHILDYLLQFYPLYSLVTSIRFLNQVGLREYTCLQGCEYLQAVYPNLECSMASMCEFHSNCCVRENPYFDWEEPGVLRYLLSMCFSCLIFWLLLMTIEYRVVQKVFTFKKTPPPIDESTLDEDVMTEARRARQVPPTRRSDHALLAHDLSKYYGKHLAVDQVSFSVNDGECFGLLGVNGAGKTTTFKMLMGDESISSGEAYVSGHSVQRNLDRVHENIGYCPQFDALFGELTGRQTLHMFALMRGLRLRTAAPSAETLAHALGFFKHLDKRVHQYSGGTKRKLNTAIAFMGRTRLVFVDEPTTGVDPAAKRHVWRATRGVQRAGRGVVLTSHSMEECEALCSRLTIMVNGRFQCLGTPQHLKNKFSQGFTLIIKMKTDDSDSDTQSVNSTTSVVDSVKLYVSGNFESPKIMEEYHGLLTYYLPDRSMAWSRMFGIMERAKQILQIEDYSISQTTLEQIFLQFTKYQREEGTTL

SEQ ID NO: 192 - protein, 1742 aa, Helicoverpa zea
MRLETRHASAATKFRLLMWKNFLQQWRHRLQTVVELLLPVVTMALVLILRWQIPPYQIDTLTYPALPAHTLNYSTNILFAMNMEELSIAYSPASPVLDDVMRTAVINLLTANMKDLIPIFIDNLPPGIANITFPPDMNLNTSAIEEFVKSRIRVVPYNSSYEIRGIYVDEETTRSIIAAVEFDDKLYGAEQLSNNLSYSLRFPERPRLNSFFQTGGRTWRSDGVFPVFEVPGPRFPHSWEGGNDPGYVNEMFVALQQVISMELVSRATGLDLKSFRVNIQRYPHPPYLHDQSVDLLQFMFPLFIMLSFSYTAVNIARAVTVEKELQLKETMKIMGLPTWLHWTAWFVKQFIYLSITAVLLVVLLKVNWFTNDDGFSEYAVFTNTPWTVLLFFLILYLSCAIFFSFMVSSIFSKGSTAALFMAVAWFLTYIPAFLLAMDINMSTAVQVITCFSINSAMSYGFQLMLAKESTGGLQWGDFMTSPGTDTTRFVFGHVVIMLVVDCLIYMLITLYLEQVLPGPFGTPKPWYFPFQLQFWFPNYKSKDAGLIFENDNSEFDDIIKEKDPTDHEVGVKMQNLTKIFGNNIAVNNLSLNIYDDQITVLLGHNGAGKSTTISMLTGNLKVTRGTVNVAGYDMTSQSSAARSHIGLCPQHNILFNELTVKEHLEFFARLKGFKGKELYEEIDSLIEKLELQEKRDYPSKGLSGGQKRRLCVGIALSGAARVVLLDEPTSGMDPSSRRALWELLQKEKKGRSMILTTHFMDEADILGDRVAIMANGRLQCVGSPYFLKRHYGVGYTLVIVKDTDFDFVKCSVLINSYIPGTIVKEDRGTEITYNLVNDYSHVFEEMLNDLERNIDNIKFKNYGLVATTLEDVFMSVGADLSPINSESDDAITTTTDSTIDDILKQEIDSSLEELDKDESNVTGLRLFGQQVLAVWMKQWLVLIRSPWVMVLQFLAPVVLINSTLGVLRYVMSLSPTIRTRWLSLEEGYTESETLLSFNGSVASSVGALAAQAYQSLFANSGVMDMEINAIGSQPIEEYYLNRTSDPVVMGSLRHRLLIGSTFDDNSATAWFSNFGYHDVATSLAAIHSAILRSKNSDAVLNVYNHPLEASYIDQSDVQTMIAMLSMQLSSGIGSSVSIVSAVFIMFYIKERMSGAKLLQNAAGVAPSVLWGGAAIFNWFWFLITCVSIVISCVAFDVIGLSNVHELGRMFLCVMVYGAAMLPLVYLLSLKFKGPAVGFVGFYFLNVLFGMMGAQVVEALSSPMLDTEQAAHILDYLLQFYPLYSLVTSIRFLNQVGLREYTCLQGCEYLQAVYPNLECSMASMCEFHSNCCVRENPYFDWEEPGVLRYLLSMCFSCLIFWLLLMTIEYRVVQKVFTFKKTPPPIDESTLDEDVMTEARRARQVPPTRRSDHALLAHDLSKYYGKHLAVDQVSFSVNDGECFGLLGVNGAGKTTTFKMLMGDESISSGEAYVSGHSVQRNLDRVHENIGYCPQFDALFGELTGRQTLHMFALMRGLRLRTAAPSAETLAHALGFFKHLDKRVHQYSGGTKRKLNTAIAFMGRTRLVFVDEPTTGVDPAAKRHVWRATRGVQRAGRGVVLTSHSMEECEALCSRLTIMVNGRFQCLGTPQHLKNKFSQGFTLIIKMKTDDSDSDTQSVNSTTSVVDSVKLYVSGNFESPKIMEEYHGLLTYYLPDRSMAWSRMFGIMERAKQILQIEDYSISQTTLEQIFLQFTKYQREEGTTL

SEQ ID NO: 193 - protein, 1249 aa, Helicoverpa zea
MRLETRHASAATKFRLLMWKNFLQQWRHRLQTVVELLLPVVTMALVLILRWQIPPYQIDTLTYPALPAHTLNYSTNILFAMNMEELSIAYSPASPVLDDVMRTAVINLLTANMKDLIPIFIDNLPPGIANITFPPDMNLNTSAIEEFVKSRIRVVPYNSSYEIRGIYVDEETTRSIIAAVEFDDKLYGAEQLSNNLSYSLRFPERPRLNSFFQTGGRTWRSDGVFPVFEVPGPRFPHSWEGGNDPGYVNEMFVALQQVISMELVSRATGLDLKSFRVNIQRYPHPPYLHDQSVDLLQFMFPLFIMLSFSYTAVNIARAVTVEKELQLKETMKIMGLPTWLHWTAWFVKQFIYLSITAVLLVVLLKVNWFTNDDGFSEYAVFTNTPWTVLLFFLILYLSCAIFFSFMVSSIFSKGSTAALFMAVAWFLTYIPAFLLAMDINMSTAVQVITCFSINSAMSYGFQLMLAKESTGGLQWGDFMTSPGTDTTRFVFGHVVIMLVVDCLIYMLITLYLEQVLPGPFGTPKPWYFPFQLQFWFPNYKSKDAGLIFENDNSEFDDIIKEKDPTDHEVGVKMQNLTKIFGNNIAVNNLSLNIYDDQITVLLGHNGAGKSTTISMLTGNLKVTRGTVNVAGYDMTSQSSAARSHIGLCPQHNILFNELTVKEHLEFFARLKGFKGKELYEEIDSLIEKLELQEKRDYPSKGLSGGQKRRLCVGIALSGAARVVLLDEPTSGMDPSSRRALWELLQKEKKGRSMILTTHFMDEADILGDRVAIMANGRLQCVGSPYFLKRHYGVGYTLVIVKDTDFDFVKCSVLINSYIPGTIVKEDRGTEITYNLVNDYSHVFEEMLNDLERNIDNIKFKNYGLVATTLEDVFMSVGADLSPINSESDDAITTTTDSTIDDILKQEIDSSLEELDKDESNVTGLRLFGQQVLAVWMKQWLVLIRSPWVMVLQFLAPVVLINSTLGVLRYVMSLSPTIRTRWLSLEEGYTESETLLSFNGSVASSVGALAAQAYQSLFANSGVMDMEINAIGSQPIEEYYLNRTSDPVVMGSLRHRLLIGSTFDDNSATAWFSNFGYHDVATSLAAIHSAILRSKNSDAVLNVYNHPLEASYIDQSDVQTMIAMLSMQLSSGIGSSVSIVSAVFIMFYIKERMSGAKLLQNAAGVAPSVLWGGAAIFNWFWFLITCVSIVISCVAFDVIGLSNVHELGRMFLCVMVYGAAMLPLVYLLSLKFKGPAVGFVGFYFLNVLFG

SEQ ID NO: 194 - protein, 1338 aa, Helicoverpa zea
MGVENKNNVQNAEGPARKTYKKPNILSRIFLWWMCPVLITGNKRNVEESDLIPPSNLYNSERQGEYLERYWLAEIENATIENREPSLWKALRKAYWVSYMPGAIFIIIQSAARTYQPLLFSQLLSYWSVDSEMTQQDAGLYALAMLGLNFVSMMCQHHNTLFVMRFSLKVKVACSSLLYRKLLRMTQVSVGEVAGGKLVNLLSNDITRFDYAFMFLHYLWIVPIQVAVVLYFLWEAAGFAPFVGLFGVVILILPLQAGLTKLTTVVRRETAKRTDRRIKLMSEIIGGIQVIKMYAWEKPFQLVVKAARAFEMSALRKSIFIRSTFLGFMLFTERSIMFVTVLTLALTGTMITATTIYPIQQYFSIIQFNVTLIIPMAIASYSEMMVSIERIQGFLSLDERSDMQVTPKINGSNNNTLFKSKKSPLEVGIVPKKYSPSEVMAAKEMQDDPTQMDYPIRLNKVSASWTGSNSSSEMTLKNISLRIRKGKLCAIIGPVGSGKTSLLQLLLKELPLNSGTLDVSGKMSYACQESWLFPGTVRENILFGLTYEPTKYKEVCKVCSLLPDFKQFPYGDLSLVGERGVSLSGGQRARINLARAIYREADIYLLDDPLSAVDANVGRQLFDGCIKGYLTGRTCVLVTHQIHYLKAADFIVVLNEGSVENMGTYDELVKTGTEFSMLLSNQENDATENEKKDRPAMMRGISKISVKSDTEMEQKAQIQEAEERATGSLKFEVVLKYLSSVQSWCLVFTAFLVLLITQGAATTADYWLSFWTNQVDSYEQSLPEGVDPDTDMNAQIGLLTTAQYLYVFGGVILALIVMTLVRITAFVAMTMRASQNLHNTIYEKLIVTVMRFFDTNPSGRVLNRFSKDMGAMDELLPRSLLETVQMYLSLTSVLVLNATALPWTLIPTSVLIVIFVLMLRWYLNTAQAVKRLEGTTKSPVFGMINSTISGLSTIRSSGSQDRQMKLFDEAQNLHTSAFHTFFGGSTAFALYLDTLCLTYLGVVMSIFILGDFGDLIPVGSVGLAVSQSMVLTMMLQMAARFTADFLGQMTAVERVLEYTKLPTETNMEQGPTNPPKEWPSAGRVTFSNVYLNYSMEDPPVLKDLNFEIQSGWKVGVVGRTGAGKSSLIAALFRLSDISGSIKIDGVDTEGLAKKTLRSKISIIPQEPVLFSATLRYNLDPFDDYSDDDIWRALEQVELKEGIPALDFKVAEGGTNFSMGQRQLVCLARAILRSNKILIMDEATANVDPQTDALIQKTIRRQFASCTVLTIAHRLNTIMDSDRVLVMDQGEVAEFDHPHILLSNPNSKFFSMVRETGESMTRTLMEVAKAKYDSDNKEA

SEQ ID NO: 195 - protein, 1742 aa, Helicoverpa zea
MRLETRHASAATKFRLLMWKNFLQQWRHRLQTVVELLLPVVTMALVLILRWQIPPYQIDTLTYPALPAHTLNYSTNILFAMNMEELSIAYSPASPVLDDVMRTAVINLLTANMKDLIPIFIDNLPPGIANITFPPDMNLNTSAIEEFVKSRIRVVPYNSSYEIRGINVDEETTRSIIAAVEFDDKLYGAEQLSNNLSYSLRFPERPRLNSFFQTGGRTWRSDGVFPVFEVPGPRFPHSWEGGNDPGYVNEMFVALQQVISMELVSRATGLDLKSFRVNIQRYPHPPYLHDQSVDLLQFMFPLLIMLSFSYTAVNIARAVTVEKELQLKETMKIMGLPTWLHWTAWFVKQFIYLSITAVLLVVLLKVNWFTNDDGFSEYAVFTNTPWTVLLFFLILYLSCAIFFSFMVSSIFSKGSTAALFMAVAWFLTYIPAFLLAMDINMSTAVQVITCFSINSAMSYGFQLMLAKESTGGLQWGDFMTSPGTDTTRFVFGHVVIMLVVDCLIYMLITLYLEQVLPGPFGTPKPWYFPFQLQFWFPNYKSKDAGLIFENDNSEFDDIIKEKDPTDHEVGVKMQNLTKIFGNNIAVNNLSLNIYDDQITVLLGHNGAGKSTTISMLTGNLKVTRGTVNVAGYDMTSQSSAARSHIGLCPQHNILFNELTVKEHLEFFARLKGFKGKELYEEIDSLIEKLELQEERDYPSKGLSGGQKRRLCVGIALSGAARVVLLDEPTSGMDPSSRRALWELLQKEKKGRSMILTTHFMDEADILGDRVAIMANGRLQCVGSPYFLKRHYGVGYTLVIVKDTDFDFVKCSVLINSYIPGTIVKEDRGTEITYNLVNDYSHVFEEMLNDLERNIDNIKFKNYGLVATTLEDVFMSVGADLSPINSESDDAITTTTDSTIDDILKQEIDSSLEELDKDESNVTGLRLFGQQVLAVWMKQWLVLIRSPWVMVLQFLAPVVLINSTLGVLRYVMSLSPTIRTRWLSLEEGYMESETLLSFNGSIASSVGALAAQAYQSLFANSGVMDMEINAIGSQPIEEYYLNRTSDPVVMGSLRHRLLIGSTFDDNSATAWFSNFGYHDVATSLAAIHSAILRSKNSDAVLNVYNHPLEASYIDQSDVQTMIAMLSMQLSSGIGSSVSIVSAVFIMFYIKERMSGAKLLQNAAGVAPSVLWGGAAIFNWFWFLITCVSIVISCVAFDVIGLSNVHELGRMFLCVMVYGAAMLPLVYLLSLKFKGPAVGFVGFYFLNVLFGMMGAQVVEALSSPMLDTERAAHILDYLLQFYPLYSLVTSIRFLNQVGLREYTCLQGCEYLQAVYPNLECSMASMCEFHSNCCVRENPYFDWEEPGVLRYLLSMCFSCLIFWLLLMTIEYRVVQKVFTFKKTPPPIDESTLDEDVMTEARRARQVPPTRRSDHALLAHDLSKYYGKHLAVDQVSFSVNDGECFGLLGVNGAGKTTTFKMLMGDESISSGEAYVSGHSVQRNLDRVHENIGYCPQFDALFGELTGRQTLHMFALMRGLRLRTAARSAETLAHALGFFKHLDKRVHQYSGGTKRKLNTAIAFMGRTRLVFVDEPTTGVDPAAKRHVWRATRGVQRAGRGVVLTSHSMEECEALCSRLTIMVNGRFQCLGTPQHLKNKFSQGFTLIIKMKTDDSESDTQSVNSTTSVVDSVKLYVSGNFESPKIMEEYHGLLTYYLPDRSMAWSRMFGIMERAKQILQIEDYSISQTTLEQIFLQFTKYQREEGTTL

SEQ ID NO: 196 - protein, 1707 aa, Diabrotica virgifera
MGEKLDKFLLLMWKNWLLQYRKPIQTIIEIVAPVLFSFLLVYIRSLSDPTYEHERIYKPFCAFEGNFNLSLPLFCNDPDAVQAGPSLFSSMQTGDSNFSLTILYTAPEDKYYDDVVGFFKLIPKVNTQRVISSGELERISLAGNSSYYGIEFGGDRDNVEVNIRFPGETVYQLDSIGRQNWRTNLVYPVFQSSGPRSPDNATGSAPNYFAEGFLAVQHFVTTALLLADKGITHDDPQGMFNFLMDASNPFPLIQMQRFPFASWFSDQLLTALTSMLGMIVMLSFVYTCINTVKSITTEKEKQLKESMKIMGLPNWLHWLAWFVKCFIFVIISVALMVVLLKVRWYSNTEFTVFTYADPFVLFVFLLLYCCSMITFCFALSVFFSKANTAATMAGLAWFISYAPYLFMQNNYTDLALSTKLLTSLLPNTAMAFGFQVVLMYEGTGDGVTWSTLFKPNTPDDTLSLGLIWIMIIINTIIYLLIALYIEAVFPGEYGVAEKWYFPFTKKYWCGKGAVSDYNNYNDHSANEFFETEPNLRPGIQIFNLKKAFGKKTAVRNLSLNMFENQITVLLGHNGAGKTTTMSMLTGMISPTNGTAKINGHDIRLDIAGVRNSLGLCPQHNIIFDELTVEEHLYFFSKLKGLSKSKITAEIDKYVKLLDLEPKRKEKSSTLSGGMKRKLCVGMALCGNSKVVMLDEPTAGMDPSARRVLWELLQKQKEGRTILLSTHFMDEADLLGDRIAIMAGGELQCCGSSFFLKKKYGAGYSLIMDKAKTCNPHKVTELLKKFIPEIEIHSNVGSELTYLLSENNAPVFEAMLKQIEQESNELGIRSYGISLTTMEEVFMKVGADHGQEEIYNEKQKKDKKEKNPILTSADLGPESLSPSYTGGLHLIVNQFVAMLMKKIIGTFRSWVLLAIQIFLPMINVIIVMSVPSGSVPSVLPAMPLNLARFTDPITLIERFDDPQNYTNNFYGVLNGYGMSPTNIDNITRIMLDLTATNPNVVRRSYIIGSTFTEQGFEFGIIKTIHPVITAWFNNDPYHSPGIALGMALSSVYNHYTNGHIEFVNKPLPFKAATQIDNIVGGQSQGFQFAFNIGFSMAFISSFYVIFLIRENVSKSKHLQFVSGVKVYIFWLVNIICDMFVYLLVCSVLLITIYCFQQDGFKTSGDMGRLFFLLLLFGWSFMPIYYVASLIFTVPSTGYTRMTLVGIFIGNAAFLLVEVLKTQSTNLKRIGETLDNVFLVFPHYSLATGINKCYAIYSYNTLCETVFDSCAQNNFTKDECISKFPSTVADICTNLNDNYFSWNNNGIAKNVTYSLISGVLWAILLFIIEYKFIARLMYYINQKFFPKQPILIQDEDDDVSKEKERIHMATDHDIRQTNILVVKDLTKYYNNFLAVNGLSIGIEKSECFGLLGINGAGKTTTFKMMSGDETVSYGDAWIEGKSVKTQLKQVQRNIGYCPQFDALLDDMTARETIIMYCLLRGIEFKRTQRIANFLSRDFDFHRHLDKKVKEMSGGNKRKLSTVLSLIGDPPVLFLDEPTTGMDPATKRYLWDSLCKIRDNGKCIVLTSHSMEECEALCTRIAIMVNGNFKCLGSTQHLKNKFAEGYTLTIKLKKLPESGGLVHADTESLEKYIKDKFPYAHLREKHQELLYYYITDTSMAWSTMFGILERAKRSDLNIEDYSLGQSSLEQVFLTFTKHQNPEGDDVKKKN

SEQ ID NO: 197 - protein, 1256 aa, Diabrotica virgifera
MTEEKKHSIKDKEKIGIDAQFVNSEEPKEKIKNVSFPQMFRYASTYDKFLMVVGLISATGTGVLQPLNTILFGSLTGDIIAYATSIQINLPADQKKIAEDNFFDGIRYFALMNSLIGIGMFVFSYLATVTFNYSAMRQIFKIRSAYLKSILNQDVGWYDINQTGDFASRMSDDLFKFEDGIGEKVPVFWSFQVVFLTSLIIALVKGWELALICLTSLPATLITIGIVGLLTTKLAKNELEAYGAAGSIAEEALSLIRTITAFGGQKKEVDRYNKNLVEAKNNNIRRSMFSALGFGLLWFMIYASYALAFWYGVKLVLRDRTATNQIYTPSNMVTVFFSVMTGSMNFGIASPYIEAFGISKAAASKIFSVIDHKPTINLSKGNGKTLNVLIGNIQFKDVAFRYPSRKDVPILKGLSLNIKSGDTVALVGSSGCGKSTVIQLLQRLYDADSGEVTIDGKNIKEYDLTWLRSQIGVVGQEPILFGTSILENIRYGKDGVTEEDFIQAAKKANAHNFIKALPNGYNTLVGEKGAQLSGGQKQRIAIARALVRNPTLLLLDEATSALDNTSEAKVQAALDAASVECTTIIVAHRLSTIRGANKIIVLSQGVVVEEGTHEELMELKQEYYRLVTAQVKSSEQFEVAEKKKVVRAISLAESSTGSDHNIEATKEDNEDDFNENKDVSVFEILKMNAPEWPYILFAGLGSIVVGCGMPVFAVLFGSILGTLANGDPDFVRSETNKYCLYFVLGGLITMVSVFTQMYLLGIAGEKMTERVRSRLFKAMIYQEIGFFDKKTNGVGALCAKLSSDASNIQGATGIRVGTILQSIATFCLAIGLSMYYEWKLGLVTAAFTPVILIAMFFERRNTRGGNDSRDSALQKSTRTAVEAVGNIRTVASLGLEEKFQQLYESELMPHYKSSLKTVHWRAIVFGLSRSLLFFAYATAMYYGGFLIRDGLPYDRVFKVSQAQIMGTVSIANSLAFSPNFAKGVAAAKKVKSFLSRIPLIRDLPSSRQMVKASGNFSFSEIEFTYPTRPNVLILKGLNLDILNGKTVALVGESGCGKSTIIQLIERFYDPRSGEVKMDGVDLKDISLDSLRSHMGIVSQEPNLFNKSIAENIAYGDNSREVSMDEIIKAAKNANIHNFITGLPKGYETKLGEKAVQLSGGQKQRIAIARALVRNPKVLLLDEATSALDTESEKVVQEALDQAKKGRTCVTIAHRLTTIQDADLICVVANGVIAESGSHQELLQKEGLYYKLYTQKT

SEQ ID NO: 198 - protein, 1169 aa, Diabrotica virgifera
MKERKKYSIKDKQKNVLDAKFVSSEEPKEKLQNVSFRQMFRYSSGYDKFLITIGLISSTGAGILQPLNTLIFGSLTGDIIEYATSMQRNLSADQKKMAEDKFFDAIRYFAIMNSVIGVGMFIFSYLATVSFNYSAIRQIFKIRSAYLKSILNQDVSWYDVNQTGEFASRMSDDLHKFEDGIGEKVPIFWSFQVVFLTSIIIALVKGWELALICLTSLPATLIIVRTVGILTTKLAKNQMEAYAAAGSIAEEALSLIRTVTAFGGQKKEVERYNKNLVLAKKNNIRRSMLSALGFGLLWLMIYSSYALAFWYGVKLVLRDRAVTNPIYTPSNMVTVFFSVMSGASNFGGASPYIEAFGISKAAASKIFSVIDHKPTINLSKENGKTLDVLKGNISFKDVNFSYPSRKNIPVLKGLSLNIKSGDTVALVGSSGCGKSTVIQLLQRLYDADSGEVTIDGKNIKEYDLTWLRSQIGVVGQEPILFGTSILENIRYGKDGVTEEDVIQAAKKANAHNFIKALPNGYNTLVGEKGAQLSGGQKQRIAIARALVRNPTLLLLDEATSALDNTSEAKVQAALDTATEEDNDDDFKENNHVSVFEILKMNAPEWPYILFAGLGSIVVGCGMPVFAVLFGSILGTLANGDPDFVRSETNKYCLYFVLGGLITMVSVFTQMYLLGIAGEKMTERVRSRLFKAMIYQEIGFFDKKTNGVGALCAKLSSDASNIQGATGIRVGTILQSIATFCLAIGLSMYYEWKLGLVTAAFTPVILIAMFFERRNTRGGNDSRDSALQKSTRTAVEAVGNIRTVASLGLEEKFQQLYESELMPHYKSSLKTVHWRAIVFGLSRSLLFFAYATAMYYGGFLIRDGLPYDRVFKVSQAQIMGTVSIANSLAFSPNFAKGVAAAKKVKSFLSRIPLIRDLPSSRQMVKASGNFSFSEIEFTYPTRPNVLILKGLNLDILNGKTVALVGESGCGKSTIIQLIERFYDPRSGEVKMDGVDLKDISLDSLRSHMGIVSQEPNLFNKSIAENIAYGDNSREVSMDEIIKAAKNANIHNFITGLPKGYETKLGEKAVQLSGGQKQRIAIARALVRNPKVLLLDEATSALDTESEKVVQEALDQAKKGRTCVTIAHRLTTIQDADLICVVANGVIAESGSHQELLQKEGLYYKLYTQKT

SEQ ID NO: 199 - protein, 1759 aa, Agrotis ipsilon
MGVDVRILTAALVLLAASSTTSAQGMPFESRCAYMTDIPRPDERPELPPIIYDGLSWNERPLVPANEDRLDVCMDEFFRGMQYIFMEEEIHGDVPIAKLNYIGDKIPYVHSTFTVGSFRLLGPEIRKISGDWHLVITNRQDYEAGTWFHAFTIRIDNEVDAEVMLAIVNIDDNDPLIDLSEPCQIAEQRDARSVKTCRYIVHDVDGEISTRFMRYEIESGRGDEEVFSLVREQAPNNEWMWCYMVVEVKGSLDFAQNPLHIFRAHAFDSKDNTHSVLMTVEVKNVEQRPPQWIEIFAVQQFDEKIKKSFRVRAIDADTGINKTISYRLRTAVGEENLFELETKEGSQGVWLHVGPIDRDELEKEVFLLSIIAYKYGDDGTLYETPANITIIINDVNDQLPSPLKEGGVYTIDIMEETPMTLNLENFGFHDRDLGPNAQYNVRLESVYPDGVHEAFYIAPERGYQRQSFFLSTQNHHMLDYDNETVDFTKIQIKAVAIDSLNNTMKGFATININLINWNDELPIFKNSVQNVSFPETVAAGFHVATIKAEDRDVGDRVEHSLMGNAVDFLTIDKYSGEIFVAVNNSFNYHRQNELFIQIRADDTLGEGPYHTTTSQLVIYLEDVNNTPPVLRLPRRGPHVEENVPHGHPITNDDGIQLIASDPDTTAELWFEIDWEESYATKQGNETLKDEYRNCIEILTRYQDENRKGEAYGVLEVRQIRDDPVVTIDYEEFEVLYLVVRVRDRNTTLGDDYDEGTLTITIIDMNDNWPTWEEGQLTQQFRVREMSLSGVVIGSLRATDRDGPLYNQVRYTIQPVDGTPADLVAIDFRTGQMTVQKNQAIDADVPPRFNLYYTVTASDKCSMEDQSNCPDDKTYWNTTAKIAIQVIDTNNKVPFVEPEKFKNEVTIVEDPVTGDVTFLTSESIYEDAVSGDHVFQLFVGDLDRDLPNNNVSYTINFGVNPRIRDFFEVDLVTGWVRVHYPGPDKLDRDGDEPTHRIHFSIFDNFMSEGEPNRNQISGEALIILLDVNDNKPELPSPDSFPPWTVSESVVEGVRIPPEILAPDRDEPGTDNSRVAYDLLGVTPERDIEVPQLFKIETIEKDLGINQTGILETVTPLQGYWGTYEIHIKAFDHGDPRQESDEKYQLVVRPYNFHEPTFVFPLDGSAIRLSRDRAIVSGELTVVGAAQAPLQRISATDEDGLHAGTVSFSVVGDDEAMNYFDVWNDGENSGMLALKQALPDGFQEFKLTIRATDAGDEPGPKSTDSTVTVVFIPQVEPQFPTNTQEVAFIEFEAGRSERHELTAAVDQKNILCDIDCYTVYYTIIGGNAAGHFALDGNVLYLVSELDRAQAERHTLQVAASNVPGVTTAAPASTLTVIVTVREANPRPHFERNLYTTGMSATDTDSERPLLTVSATHSEGLPITYAIDQDSMVLDPTLEQVRESAFSMNPETGELMRMIQPNANMHGMFEFDILATDTAGATGQSHVKVYLISSRNRVYFTFYNSQESVQEHRTFIAQTFTRVYSMTCNIEDIVPATDSNGQYLTTETHVTAHFIRDDLPVDADDVQELIEDTELFRELRTTMLGLGLQLTNVQSGLPPSVAGEDQMLAVYILAGLAGVLALLCIVLLITFIIRNRSLNRRIAALSATKYNSVDSNLNRIGLAAPGTNKHAFEPNPIWNETIKAPDFDAISEQSNDSDLIGIEDLPQFRNDYFPPEQEIDMNSNDIGYPEMDARNPLPNHENNFGYSNAPFNPDFTNSQSRR

SEQ ID NO: 200 - protein, 538 aa, Agrotis ipsilon
MRSLVLLFVTLCAGAVRADRYHPADPLGRAAAANRAETDSTFWTGEAQAAIKARLAHKESVKKARNVVMFLGDGMSVPTLAAARTLLGQRRGETGEEAKMHFETFPTVGMVKTYCANAQIADSACTATAYLCGVKTTYGAIGVNAAVQRGNCEASTNRNTHVQSIAEWALADGRDAGIVTTTRITHASPSGVYAKVADRDWEYNEQVEKEGYDTERCPDIALQLVHSHPGNKLKVILGGGRRSLLPTGFLDEEGSEGRRTDNRNLIDEWKQDKKNREVSYQYVWNREQLLQANDTLPEYLLGLFENNHCQYNLKANLETEPTLTEMTEVAIRSLSRNEKGFFLFVEGGRIDHAHHDNLVELALDETIEMDKAVARAAEMLSEEDSLIVVTADHSHVMAFNGYSGRGHDILGPSRDKGNDSMPYMTLSYTNGPGFRAHVDGVRPNVTDEDNFRQLDWESHVDVHLEWETHSGDDVAVFARGPHHSMFTGLYEQSQLPHLMAYAACIGPGEHACSGSAQVVTIPATFITIFVLLASHFMQ

SEQ ID NO: 201 - protein, 538 aa, Agrotis ipsilon
MRSLVLLFVTLCAGAVRADRYHPADPLGRAAAANRAETDSTFWTGEAQAAIKARLAHKESVKKARNVVMFLGDGMSVPTLAAARTLLGQRRGDTGEEAKMHFETFPTVGMVKTYCANAQIADSACTATAYLCGVKTTYGAIGVNAAVQRGNCEASTNRNTHVQSIAEWALADGRDAGIVTTTRITHASPSGVYAKVADRDWEYNEQVEKEGYDTERCPDIALQLVHSHPGNKLKVILGGGRRSLLPTGFLDEEGSEGRRTDNRNLIDEWKQDKKDREVSYQYVWNREQLLQANDTLPEYLLGLFENNHCQYNLKANLETEPTLTEMTEVAIRSLSRNEKGFFLFVEGGRIDHAHHDNLVELALDETLEMDKAVARAAEMLSEEDSLIVVTADHSHVMAFNGYSGRGHDILGPSRDKGNDSMPYMTLSYTNGPGFRAHVDGVRPNVTDEDNFRQLDWESHVDVHLEWETHGGDDVAVFARGPHHSMFTGLYEQSQLPHLMAYAACIGPGEHACSGSAQVAAIPATFITIFVLLASHFMQ

SEQ ID NO: 202 - protein, 1734 aa, Spodoptera frugiperda
MAVDVRILTATLLVLTTATAQRDRCGYMVEIPRPDRPDFPPQNFDGLTWAQQPLLPAEDREEVCLNDYEPDPWSNNHGDQRIYMEEEIEGPVVIAKINYQGNTPPQIRLPFRVGAAHMLGAEIREYPDATGDWYLVITQRQDYETPDMQRYTFDVSVEGQSLVVTVRLDIVNIDDNAPIIEMLEPCNLPELVEPHVTECKYIVSDADGLISTSVMSYHIDSERGDEKVFELIRKDYPGDWTKVYMVLELKKSLDYEENPLHIFRVTASDSLPNNRTVVMMVEVENVEHRNPRWMEIFAVQQFDEKQAKSFTVRAIDGDTGINKPIFYRIETEDEDKEFFSIENIGEGRDGARFHVAPIDRDYLKRDMFHIRIIAYKQGDNDKEGESSFETSANVTIIINDINDQRPEPFHKEYTISIMEETAMTLDLQEFGFHDRDIGPHAQYDVHLESIQPEGAHTAFYIAPEEGYQAQSFTIGTRIHNMLDYEDDDYRPGIKLKAVAIDRHDNNHIGEAIININLINWNDELPIFDEDAYNVTFEETVGDGFHIGKYRAKDRDIGDIVEHSILGNAANFLRIDIDTGDVYVSRDDYFDYQRQNEIIVQILAVDTLGLPQNRATTQLTIFLEDINNTPPILRLPRSSPSVEENVEVGHPITEGLTATDPDTTADLHFEIDWDNSYATKQGTNGPNTADYHGCVEILTVYPDPDNHGRAEGHLVAREVSDGVTIDYEKFEVLYLVVRVIDRNTVIGPDYDEAMLTVTIIDMNDNWPIWADNTLQQTLRVREMADEGVIVGTLLATDLDGPLYNRVRYTMVPIKDTPDDLIAINYVTGQLTVNKGQAIDADDPPRFYLYYKVTASDKCSLDEFFPVCPPDPTYWNTEGEIAIAITDTNNKIPRAETDMFPSEKRIYENTPNGTKITTIIASDQDRDRPNNALTYRINYAFNHRLENFFAVDPDTGELFVHFTTSEVLDRDGEEPEHRIIFTIVDNLEGAGDGNQNTISTEVRVILLDINDNKPELPIPDGEFWTVSEGEVEGKRIPPEIHAHDRDEPFNDNSRVGYEIRSIKLINRDIELPQDPFKIITIDDLDTWKFVGELETTMDLRGYWGTYDVEIRAFDHGFPMLDSFETYQLTVRPYNFHSPVFVFPTPGSTIRLSRERAIVNGMLALANIASGEFLDRLSATDEDGLHAGRVTFSIAGNDEAAEYFNVLNDGDNSAMLTLKQALPAGVQQFELVIRATDGGTEPGPRSTDCSVTVVFVMTQGDPVFDDNAASVRFVEKEAGMSEKFQLPQADDPKNYRCMDDCHTIYYSIVDGNDGDHFAVEPETNVIYLLKPLDRSQQEQYRVVVAASNTPGGTSTLSSSLLTVTIGVREANPRPIFESEFYTAGVLHTDSIHKELVYLAAKHSEGLPIVYSIDQETMKIDESLQTVVEDAFDINSATGVISLNFQPTSVMHGSFDFEVVASDTRGASDRAKVSIYMISTRVRVAFLFYNTEAEVNERRNFIAQTFANAFGMTCNIDSVLPATDANGVIREGYTELQAHFIRDDQPVPADYIEGLFTELNTLRDIREVLSTQQLTLLDFAAGGSAVLPGGEYALAVYILAGIAALLAVICLALLIAFFIRNRTLNRRIEALTIKDVPTDIEPNHASVAVLNINKHTEPGSNPFYNPDVKTPNFDTISEVSDDLLDVEDLEQFGKDYFPPENEIESLNFARNPIATHGNNFGVNSSPSNPEFSNSQFRS

SEQ ID NO: 203 - protein, 983 aa, Spodoptera frugiperda
MRFTGVIVLALVALAWADGPLPLDTERVNTLNPASDSYRLPEDLDPISYDIEVTPYFTAETTPPGKTQFTFDGTVTIVFKVLKPNLNSFVIHENVREITGVRIFKDENNEMVNVLSHERDRVHQFLKINLATGTTLEVGAKYRLLVIYVGNINETPLSRGVFRGNYKDEKGVTRWYLATHLQPTHSRQAFPSFDEPGFKSTFKITINRPTSFTESFSNMKLLHSIPNGERTKEIFEETPRMSAYLVTFHVSDGFKVIADNNDAERSYRILARPNAEGQGEYALEIGTPITNWLSDYLKIDYYSMATGIKNDQIASPYWASGATENWGLVTYRELRLLYEEGETNAADKLSIGTITAHELAHKWFGNLITCRWWDNVWINEGFASYFEYFAMDGAYPDLELADQFNIMYLQSALSMDSSTNTRALQHTVNSPSEVTSHFTDISYSKGASFLLMLKHLVSKETFRQALYYFLEDRKYEHAFPSHLFDAFEKAVAEKSPEGNALDIKSFMSYWVFEQGYPVLDVKVNSQAGTIELEQDRFFISPSATPTQQVWPLPITYTTQSSPNWNNLDPVKVMTTKTDTLQNVPTDGWVIFNVQQKNIYRVNYDTENWLKLAAQLQTDHNAIHHLNRAQIVDDVFALMRSERLSLQVGFQVLQFLKKDTSFYVWYPAISGFNWIRNRLLHTEQLPIFDKLLFSYLTNVIEDVGFDVDPNEHITRTLNRFYILNFACNIGHEECINNSVNKFRSYSSGDVLSVNPNVRRHTFCEGLRAGGYEEWSFLFKRRQESNNQADEVAMLRALGCTTNNEARNEYLKNILTEDVKAQDRVNAFTFFYMGDASNAKFAIPFIKENIKDIEKAVVLPAWFSNIFSNIAGYLDEEGLEEYSTMLTSLEAEYPSAFTAGNNAINSARANIAWGNEKVAQITDIANGQLSTTTTTTTTTTTSTEAPPSSSSEEPTTTPEPAPGSASVAFPATIMLLWTALAIMLQ

SEQ ID NO: 204 - protein, 936 aa, Spodoptera frugiperda
MCRLLLTVALTCVLYTSVYTTDTNYRLNTPLIPSEYQLLITPYFETGDARQFTFDGTVSIQLTPSSSTNEIKLHSEDLIFTAQDVAVAVFSTGVTIPLNAANPIEFNKNYTFAYINLSENLQTGVQYILQIKYQGPIRTDLNGFYRNYYFQNGVKKWLGATQMEPTHARKVFPCFDEPELKATFVIGIDRPADYQPSLSNTDIERRELLANGYIREVFYRTPRMSTYLVAFLVSEFEAAASSLDGTNEFGIYTRPDAKNQSDYAFDFGKKVVDALSSYFGINYYSTNSHLRLDHVALIDFRAGAMENWGLIKYRESLLLYVPGQSTPYFKYRVAQIMAHETTHMWFGNLVTCHWWSNTWLNEGFANYFQDYITSFVDPSVGAGNQLVIGSVYSAYDADNSPTSPPITNNAVNSPAEISGHFGTITYQKAGSVIRMMHHLIQDEAFKYGLNYYLTINSFNPGYPDKLYEGLHQGVQRYNSLSSFPGHNISEVMNSWISQAGHPVVKVTIDYSTNVVTLTQKRYYVNSSISSNETYKIPITYTTGMAPDFENTRPVFIMEDQTFTLTISNLSNEHSWVIFNLQETGLYRVNYDDHAWSIIISALKGDHSAVIHPLNRAKIINDLFALVYADEVSFSTLSSALDYLPSEPEYPGWFAALRGFSKIWHFYLGDNEVLPHVEHFILHHLESGITRLGYEERSTDSLEDQRNRMQILEFACKLEYSGCVERTVALFRALKENGTEVAASLRPVVYCTGLRHGSAEDYDFLWNRMVNTNLANEVWVIGDALGCTSDENRIRSFLTSMTVENSPIKTQDLTVPLASVLRTYGNRHIVMDALKTNYTLWSSIYPSMDTVLNTVASALHTEADFNEFESFLSECTVCTEAAKTSGRNALVQARAITDWANSHKADILKVIRSNSIMASPSVIVMLLGLAILIFKEF

SEQ ID NO: 205 - protein, 971 aa, Spodoptera frugiperda
  misc_feature (64)..(64): Xaa can be any naturally occurring amino acid
  misc_feature (253)..(253): Xaa can be any naturally occurring amino acid
MYLLTLLALIGSAFAVPVTELSKQSHAEKYVLPRTVMPSFYDVVLFLDPDNEAYFEGSVDIRIXPVVATNEIVLQAMEMTIDSNNIEVFTDIQPENNLYSSHTLATDDTHLFKIQLKETLPAARVHTIRIKNFRGQYATNMFGIYVSTYTNEAGQTEKLITSQLQPTFARRAFPCFDEPSFKARFRTTIYARPSYSVVESNMPLSPPEDLRKENVQGWNKYEFQDTPLMSTYLLAYLVSNFEKIDNSVEPIFXVPFKVFSRPGMQKPAEFALEFGQKNMVALQNYVEFDYVLPKLDKAAVPDFAAGAMENWGLVIYREVALLVTDGVTTTATKQNVGRIICHENVHQWFGNEVSPDSWTYTWLNEGFANFFENFATDMVLDEWRMMDQFVLALQNVFQSDAVLMVNPMTHAVYSPSEVISTFNAVAYQKSGSVIRMMQHFLTPEVFRKGLVIYIKKHTRQAVLPSHLYAALQQALDESDHSIPFPLIEVMTRWENQGGFPVLTVTRSAPTAQSIHVAQERYLTDNKLTAPDRWHVPINWVLSTNPDFTDTKPQGWVRPTFPALSFDIPGLAQADWYILNKQQTGYYRVNYEVSNWVALASALGENHDVIHVLNRANLLDDAFNLARNGRLNYQVALSLSRYLVKEEDYIPWGAVNPSITYLDSVLTGSSVYKLFQQYILQLTAPLYEKLGFIADNDEEHVTAYHRNIILDLNCRHGNEACTSTAQTLLENFKDNPVAHNLNPDIQNLVYCAGLRGGSVDNFNFLWERYLNSQDHSEQSILLNALGCTSNAERREFYMNQVISDSSPVREQDRHTILVSVTNASPESTNAALDFVVEHFAAIQPRVQGLTGTTNILNAFARRLTTQEHSAKIDELHTRHQAIFTAGELASIAGIRDNIAASITWNNEYAQVVDDWFQDNYGEGSGGDTDDSGVEGSGEDGDGGGEDPAGGGAASLVSGLVILISFVATFFNH

SEQ ID NO: 206 - protein, 1009 aa, Spodoptera frugiperda
MVAIKLIVLSLACLSAAAVSPIEPAKRNTIFADERFEGEVFENVDAFDNIELTPSNIGISPYRLPTTTAPIKYDVHWNFEFTNQRIYSGTVVITLVAKQPNVNQIVIHSSHTVNTGPELKLGTQVIPITASAKEEYHFYIVTLNDGQVLEYNEAQPVEYTLKIDFSAAFRTDMYGIYESWFRNTPNEEVQWMATTQFQATAARFAFPCYDEPSFKAKFNVKITTPADYSSWFCTTAKPSSPPATPTQFVTVEYNETPVMSTYLLALIVSKQYKSINNENPAKFHEVIARQGAIDAKQGEYALKTGQALLDKMSEITQYDFYDQHATLKMTQAAIPDFGAGAMENWGLLTYREAYLLSDPLETSSQFQQIIAYILSHEIAHMWYGNLVTNDWWDVLWLNEGFARYYQYFLTNEVEGMGFDIRFVPEQVHTALLSDSSNNPHPLTNPGVGSPRSVSAMFSTLTYNKGAAVIRMTEHLLTKQVHDQGLAQYLKTNQFKTAKPIDLFNALRDAGMQHGAFNNYGPTFDFVEYYKSWTEQAGHPVLNVDINHTTGQMTIQQRRFNINTGYSLQNTLYVIPVTFTSEFDYNFQNTKPTHIIKDAVTVIDRDAYGDYWTIFNIQQTGFYRVNYDEYTWNLIALALRGDQWNSNIHELNKAQIVNDVFSFARAGLMKYDRALHILAFLARETDYAPWAAAITGFNWLRNRLAGHPLEANLNNLIRAWAKKAMDELTYEPASDATFMDRYFRFQLAPLMCNVGDTECREKAKTFFDGLKATPSVSVDRDNRNWVYCNGLRQGTPADFDFLWDRFSKENLYTEKIVLLQILGCTPHKESLEKYLNAILRAPNTVRPQDYNTAINSAVSGNEANTQIVLDYFKVSDNLQSLRTAYNNDLRTPLSYISSRLRTAAQVEDFKTWVNGQTNLEYRDDIIAGADDTLESFKFVESISSYLEDYFTGTDDPISTSTILPTTAGPTSTVTAPSLVQPTTPDLPASAVTSVVSIFLLTLAGIAHFIL

SEQ ID NO: 207 - protein, 541 aa, Spodoptera frugiperda
MRSLLTYLVAAVMVAACVRGDRYHPADPGSRADTVVNRAETSANYWAQEAQAAINARLAHKESVKKARNVVMFLGDGMSVPTLAAARTLLGQRRGHTGEEDKLHFETFPTVGLTKTYCVNAQIPDSACTATAYLCGVKTTYGAIGVNAEVPRKGCEASTDTSRHVESIAEWALADGRDAGIVTTTRITHASPAGVYAKVADRNWEHNQAVENDGFDTDKCPDIALQLVHKHPGNKLKVILGGGRLNFLPNDVKDEEGVYGNRTDTRNLIEEWAQDKEDRKVTHKYVWNREQLMSLKDDLPEYLLGLFESNHLQYNMQADPNTEPTLTELTEIAIKSLSRNEKGFFLFVEGGRIDHAHHRNWVELALDETLEMDKAVARAAELLSEDDSLIVVTADHSHVMAYNGYSARGHDILGPSRDLDLDGVPYMTLSYTNGPGFRSHMNGIRPDVTAEDDFRKDGWLAHVDVPLIDETHGGDDVAVFARGPHHSMFTGLYEQSQLPHLMAYAACIGPGRHACSGAAHALAQPVLLLSLLVLLTSLFQQ

SEQ ID NO: 208 - protein, 541 aa, Spodoptera frugiperda
MRSLLTYLVAAVVVAACVRGDRYHPADPGSRADTVVNRAETSANYWAQEAQAAINARLAHKESVKKARNVVMFLGDGMSVPTLAAARTLLGQRRGHTGEEDKLHFETFPTVGLTKTYCVNAQVPDSACTATAYLCGVKTNNGVIGLNAEVARGDCEASTDAGRHVESIAEWALADGRDVGIVTTTRVTHASPAGVYAKIANRTWEYDLSVALTGSDPERCPDIAYQLVHNHPGNKFKVILGGGRRNFVPDNVLDDEQRYGRRTDNRHLINEWNKDKEDRGVSHKYVWNREQLMSLKDDLPEYILGLFHRSHLPYHMQSNSARDPTLTEMTEIAIQSLSRNEKGFFLFVEGGRIDHAHHDNFAELALDETLEMDKAVARAAELLSEDDSLIVVTADHAHVMAYNGYSARGHDILGPSRDLDLDGVPYMTLSYTNGPGFRPHVNGIRPDVTAENDYEKLEWRAHVDVPRDSETHGGDDVAVFARGPHHSMFTGLYEQSQLPHLMAYAACIGPGRHACSGAAHALAQPVLLLSLLVLLTSLFQQ

SEQ ID NO: 209 - protein, 1717 aa, Ostrinia nubilalis
MGVERFFPAVLLVSLASAALANQRCSYIIAIPRPETPELPPIDYEGKSWSEQPLIPGPTREEVCMENFLPDQMIQVIYMEEEIEGDVIIAKLNYQGSNTPVLSIMSGQPRAQLGPEFRQNEADGQWSLVITQRQDYETATMQSYVFSIQVEGESQAVLVALEIVNIDDNPPILQVVSACVIPEHGEARLTDCVYQVSDRDGEISTRFMTFRVDSSRAADESIFYMVGEYDPSDWFNMKMTVGINSPLNFETTQLHIFSVTASDSLPNNHTVTMMVQVENVESRPPRWVEIFSVQQFDEKTNQSFSLRAIDGDTGINRAINYTLIRDDADDFFSLEVIEDGAILHVTEIDRDKLERELFNLTIVAYKSTDASFATEAHIFIIVNDVNDQRPEPLHKEYSIDIMEETPMTLNFNEEFGFHDRDLGENAQYTVELEDVFPPGAASAFYIAPGSGYQRQTFIMGTINHTMLDYEDVIFQNIIIKVKAVDMNNASHVGEALVYVNLINWNDELPIFEESSYSASFKETVGAGFPVATVLALDRDIDDVVVHSLMGNAVDYLFIDESTGEIFVSMDDAFDYHRQNTLFVQVRADDTLGDGPHNTVTTQLVIELEDVNNTPPTLRLPRSTPSVEENVPEGYEISREITATDPDTSAYLWFEIDWDSTWATKQGRETNPTEYVGCIVIETIYPTEGNRGSAIGRLVVQEIRDNVTIDFEEFEMLYLTVRVRDLNTVIGDDYDEATFTITIIDMNDNAPIFANGTLTQTMRVRELAASGTLIGSVLATDIDGPLYNQVRYTIQPRNNTPEGLVKIDFTTGQIEVDANEAIDADEPWRFYLYYTVIASDECSLENRTECPPDSNYFEVPGDIEIEIIDTNNKVPEPLTEKFNTTVYVWENATSGDEVVQLYSHDRDRDELYHTVRYTMNFAVNPRLRDFFEVDLDTGRLEVHYPGDEKLDRDGDEPTHTIFVNFIDNFFSDGDGRRNQDEVEIFVVLLDVNDNAPEMPLPDELRFDVSEGAVAGVRVLPEIYAPDRDEPDTDNSRVGYGILDLTITDRDIEVPDLFTMISIENKTGELETAMDLRGYWGTYEIFIEAFDHGYPQQRSNETYTLVIRPYNFHHPVFVFPQPDSVIRLSRERATEGGVLATAANEFLEPIYATDEDGLHAGSVTFHVQGNEEAVQYFDITEVGAGENSGQLILRQLFPEQIRQFRITIRATDGGTEPGPLWTDVTFSVVFVPTQGDPVFSENAATVAFFEGEEGLRESFELPQAEDLKNHLCEDDCQDIYYRFIDGNNEGLFVLDQSSNVISLAQELDREVATSYTLHIAASNSPDATGIPLQTSILVVTVNVREANPRPIFEQDLYTAGISTLDSIGRELLTVRASHTEDDTITYTIDRASMQLDSSLEAVRDSAFALHATTGVLSLNMQPTASMHGMFEFDVIATDTASAIDTARVKVYLISSQNRVTFIFDNQLETVEQNRNFIAATFSTGFNMTCNIDQVVPFSDSSGVAQDDTTEVRAHFIRDNVPVQAQEVEAVRSDTVLLRTIQLMLSTNSLVLQDLVTGDTPTLGEESMQIAVYALAALSAVLGFLCLVLLLALFCRTRALNRQLQALSMTKYGSVDSGLNRAGLAPGTNKHAVEGSNPMWNEAIRAPDFDAISDASGDSDLIGIEDMPQFRDDYFPPGDTDSSSGIVLHMGEATDNKPVTTHGNNFGFKSTPYLPQPHPK

SEQ ID NO: 210 - protein, 994 aa, Ostrinia nubilalis
MARSWVLLLAGVALLQGVCTFNPLPLLEEEEAWEKFSRELNDASFRLPTTTMPMHYELSLTPYFEDEERPFTFDGTVAIYTSATEENVSEIVIHCNDLTIHSLTVEHTDAEGVVQQIAAPRTYECEAPQSFLRIATIEPLQVGQEYIIRSSFTGNLQSNMNGFYRSWYRDSTTTRWMATTQFQPGYARQAFPCYDEPGFKATFDITMNREPDFSPTISNMPIKTTENTTDGRISETFYTTPITSTYLLAFIVSHYDKVETNNDEDRPFDIYARDNANGTGAWSLEIGMKLLEAMENYTDYPYYTMAEKINMKQAAIPDFNAGAMENWGLLTYREALILYDPLNSNHFYKQRVANIVSHEIAHMWFGNLVTCAWWGNLWLNEGFARFYQYFLTGSVAPELGYERRFMVEQYISALSVDSVDSAHALTNPDVYNPTTVWNHFSTITYARGACILRMTQYLLGQETYVKGLRSYLKERAFDVAEPHHLFNALDAAAREDGALAAYGGITIDRYFRTWSEKAGHPMLSVTIDQRTGTMQVTQARWERTTGSSAFPGIWDIPITWTREGAADFDDLKPSQFLTAQSTVIERGTEGLEWVIFNKQASGFYRVNYDDTNWALIVQALRNNPNVIHEFNRVQIIDDLFNMGRAGVRPYQQVLNLLSFLQFDDEYGPWIAAIDGFNFVLRRLAHDEPNLQKLRDIINKELSVAVTGRLGYVEVENETFMDGILRMYLMNFLCDNGHEECIATGIEKFAEWKAGGFIPANMRPWVYCTGLRFGDAEDFEFFWNRYLQEDLAGEQIVMLQNAGCTRDEASLRKFLDAIVSQQNIVRDQDFTTALTSAVSKNEYNTMRAFAWLKDNVNQTTEALGGIATPLSYIVSRLLNEQDMAEVQTWLNENQDSIGTAYNTGVNGIASSRNNLAWSARRMPEVYEYFDNGVYVEYEIEDPTQEEVTTEESVTVTPPELDLEVTTEVDDESDSANIAALSIFTLIISVTINLIS

SEQ ID NO: 211 - protein, 940 aa, Ostrinia nubilalis
MLLLLVALIGSAVASPVSEVESRTLTNEQLAAQYNLPRETIPTFYDVTLFLNPSYPDNFNGSVSIRIVPNITTNVIVLHAMEMEILNIEVFNVLNTTADIFQTHFLATDDTHFLRIFTNELMLPNQLYIVNIEYRGQYASNMFGIYVSTYEQAGLGTVNLVTSQLQPTFARRAFPCYDEPALKAIFRTTIYAPPGYPTVRSNMPLRNDTNKPEIAGWVKHEFQDTLDMSTYLLAYLVSSFEYISNEDDPIYEVPFRVYSRPGTQNNSEFALDFGQKNMIALENYIELPYAFPKLDKAAVPDFAAGAMENWGLVIYREVALLVTEGVTTTQTLQDIGRIICHENMHMWFGNEVGPYSWTYTWLNEGFANFFENFATDLVNPHRRMMDQYVIAVQNVFQSDAVLSVNPMTYPVFTPSQIISTFNAVAYQKSGSVIRMMQHYLTPEIFRQGLVQYVSNMSRKAAQPSDLFANLQEALDASNHSIPWPIATIMDRWTNQGGFPVLTVFRSAPTANSLTIAQERFLTDRSLTSTDRWHVPVNWVLSTDPNFNDTSPQGWIPPSFPAVSMDIPGLNQAEWYIVNKQQTGYYRVNYDVQNWAALASVLNSTHEVIHVLNRAQIVDDAFNLARNGRVNYNYALEISRYLVREEDYIPWAAANAAFAYLDVVLTGSEVYHLFQRYVLELTAPLYSSLGSNNTANDEFVTAYHRTIVLNFNCRFGNEHCVEAAQEMLESFRTTQVRLAADIQTTVYCSGLRGGDADNFDFLWDEYLKSTDSSEQSILLNALGCTSNADRRQFYMNQVISETSQVREQDRHTILVSTINASPENMEEALDFVVENFHLIQPRVQGLSGTTNILNALSRRLTTQAHSDKVDQLFNRHQFIFTAGELASIGAIRENIAASPTWSAEYLDTVESWLIENYTDSASIITSSFVIFISIFISIFNH

SEQ ID NO: 212 - protein, 1014 aa, Ostrinia nubilalis
MATLKLLILAAACLAAQAFPQDPRPYRNTIFADEKLEGEAFENIDDFDGNTQLSRSDDNPYRLPTTTRPEHYNILWMVEIPANIFSGEVEIQLYATQENVNEIVIQANGLNITSVVLKLGDTEIPHTVTLQPEYHFLRVALSNGVLQYSATNRVLYSLNIEFIAPLRTDMYGIYENWYRNNASDENVSWMASTQFQATSARYAFPCYDEPSFKATFNITLRRPVGFKSWTGMRLQNNITSPIEGFVDDVFFITPIQSTYLLAIIVAEYETLEKLNEITGDLEYEVIARPGAIQSGQAQYAFEVGQELLAEMSNHTAMDFFSVHPHVKMTQAAIPDFSAGAMENWGLLTYREAYLMYDENHTNSYFKQLIAYILSHEIAHMWFGNLVTCDWWDVLWLNEGFARYYQYFLTDWVETYMGLSTRFINEQVHTSLLSDSSNNPQPLTNPGIGSPSSVSSMFSTISYNKGAAIIRQTEHLMGFDVHREGLRRFLVERSFETALPIHLFQALQDAAVEAGAIAEYGEEFNIIDYYKTWTEQGGHPVLNVEIDHQTGLMTIYQRRFNINSGYSTPTTNWIVPITFATASDPDFNNTKPSHIIRDGITVINRNSIGDEWVIFNKQQTGYYRVNYDDYSWNLIINALRGPDRTQIHEFNRAQIVNDVFQFARSGIMTYTGAFNILSFLENETEYTPWVAAITGFNWIRNRLIGSSYLAELEAMIANWATTVMNQLTYYPRPDESFMDSYLRYQLAPFMCNLNQTACREAAVSQFEALRYNDTEVPVDSRNWVYCNALRQGSEEDFDFLWERFQNHNVYTEKIVLLQVLGCTPHEASLKTLLDAIVTPNFVIRRQDYTTAFSTAVNGNEGNTQIVFNYIQTNLTQVAAAFGTILNPINYATPLSYISARLRSTEEIDNFQAWANATQDILGNSYNSIYNSAESSRDSLQWAVEVQSDIENYLTEGDETYEASSETPVVTDAPVTETQPPLEEPTTPELSESDSANTAFLSVLVIAVAAAANFAL

SEQ ID NO: 213 - protein, 947 aa, Ostrinia nubilalis
MGSIMLLPILFFLAGVAAYPNEDMRSDLEFFGYSTNLDDPKYRLTDSVQPRDVYVHLDVHVVEARFDGFIQLDVEIEESGMTQIVLHQKVVSIQTVNVLDSAGRPVNLQFPNPFSTDDHFEILLINLADPISAGNYTITISYLGKIHENQYDRGFYQGYYFYNGEKRYYATTQFQPFYARTTFPCFDEPQFKSRFVISFTRDSSLQPSYSDMPIGETVETSPGRIRETFLPTPIVSAYLVAFTVSDFVATNLTTTSTRPFQIVSRPGVTSRHVYAAGIGLDITNELDDYLGIEYYEMGQGVPMKNDHLAIPDFPSGAMENWGMVTTAYLLYDEENTNVINKIFIATIMAHELAHKWFGNLVTCFWWSNLWLNESFASFFEYFAAHYADPSLELDDQFIVDYVHSALSWDSGSGATPMNWTGVVNNPSIWSHFSTTSYAKGASVLRMMEHFMGARPFRQGLRYYLRENAYGLGTPEDLYRALRRAAYEDMAFRRDFPDADVGQILDNWVQNPGSPVVNVDVNMDTGLITLTQERFLLSGTPVAQLWDIPITWTHRGELNFESTRPSFILSTASTTIQNTPGHFWVILNIAQSGLYRVNYDDHNWEMLASYLRNANTLTNVHKLNRAQIVNDVLFFIRAGKISLERAFDVLSFLKIETDYYVWNGAITQLEWIRKRMEHIPLAHQKFTEYMLDILDAAIQHLGYEELATDSTSTILNRVQLMSLACNLGHSGCIADSLNKWRAFVADPTTLVPVNARRYVYCTGLREGDASDYEFLLNLYETSENTADMVVMLRALACTKDTASLNQYLNQSLTNDKSRFHDRTNAFAYALQGNVENLPTVLGFLYNNFAAIREAHGNQDRLIVNINNVAGFLTNYEHIVEFQTWAYANQLALGSAFQNAVNVVNSAMNNLNWGNSVAAEVYDILLARNSAAAIVSPIALILAAMATVL

SEQ ID NO: 214 - protein, 537 aa, Ostrinia nubilalis
MRGAVLVTTLVLVVQARGAVRDRYHPNARAAGRSSAAERDPAHWAAEAAAAIDERVRRRNNRNAARNVVMFLGDGMSVPTLAAARTLLGQRNGQTGEEAQLSFEAFPTSGFSKTYCLDAQIADSARTATAYLCGVKANIGTIGLNGNVVRRDCDASFNTDNHVESIAARALEDGRDAGIVTTTRVTHASPAGAFANIANRDWENDESVREDGADPARCPDIAHQLVHTSPGNQFKVILGGGRREFLPFNFTDEEGSPGVRHDNRNLIEEWQENKAAQGASYAHVSNRDQLMNVSSSLPDYLLGLFENSHMQYHLEANNVTEPTLAELTEIAIKSLSRNEKGFFLFVESGRIDHGHHDNYVELALDETIQMSEAVRVATELLSEEDSLIVVTADHAHVMAFNGYTQRGGDILGVSDDRDEDGVPYMTLSYTNGPGARQQVNGTRPDVTTEDDFGGRRWRAHVEIPLDSETHGGDDVGVFARGPHHDLFTGVYEQSQLPHLMAYAGCFGPGPHACNAGPATHIPYFLLALITLCQILRL

SEQ ID NO: 215 - protein, 544 aa, Ostrinia nubilalis
MRGAVLLSTLVLAALARGAVRDRYHPDARAAPEPGRAAARSSAAERDLAHWAAEAAAAIDERARRRNNRNAARNVVMFLGDGMSVPTLAAARTLLGQRNDQTGEEAQLSFEAFPTSGFSKTYCLDAQIADSACTATAYLCGVKANRGTIGVNGDVPRWDCNASTDPDTHVESIAAWALKDGRDAGVVTTTRVTHASPAGAYASVANRHWENDDARARGRRRPRALPRHRAPARPHEPRESVQGYIGCGRREFLPFNFTDEEGSPGVRYDNRNLIKEWQENKAAQGASYAYVSNRDQLMSVSSSLPDYLLGLFENSHMQYHLEANNVTEPTLAELTEIAIKSLSRNEKGFFLFVESGRIDHGHHDNYVELALDETIQMSEAVRVATELLSEEDSLIVVTADHAHVMAFNGYTQRGGDILGVSDDRDEDGVPYMTLSYTNGPGARQQVNGTRPDVTTEDDFGGRRWRAHVEIPLDSETHGGDDVGVFARGPHHDLFTGVYEQSQLPHLMAYAGCFGPGPHACNAGPATHIPFFLLALITLCQILRL

SEQ ID NO: 216 - protein, 1730 aa, Helicoverpa zea
MAVDVRILTAAVFIIAAHLTFAQDCSYMVAIPRPERPDFPSLNFDGIPWSRYPLIPVEGREDVCMNEFQPDALNPVTVIFMEEEIEGDVAIARLNYRGTNTPTIVSPFSFGTFNMLGPVIRRIPENGGDWHLVITQRQDYETPGMQQYIFDVRVDDEPLVATVMLLIVNIDDNDPIIQMFEPCDIPERGETGITSCKYTVSDADGEISTRFMRFEISSDRDDDEYFELVRENIQGQWMYVHMRVHVKKPLDYEENPLHLFRVTAYDSLPNTHTVTMMVQVENVENRPPRWMEIFAVQQFDEKTEQSFRVRAIDGDTGIDKPIFYRIETEKGEEDLFSIQTIEGGREGAWFNVAPIDRDTLEKEVFHVSIIAYKYGDNDVEGSSSFQSKTDVVIIVNDVNDQAPLPFREEYSIEIMEETAMTLNLEDFGFHDRDLGPHAQYTVHLESIHPPRAHEAFYIAPEVGYQRQSFIMGTQNHHMLDFEVPEFQNIQLRAVAIDMDDPKWVGIAIINIKLINWNDELPMFESDVQTVSFDETEGAGFYVATVVAKDRDVGDKVEHSLMGNAVSYLRIDKETGEIFVTENEAFNYHRQNELFVQIPADDTLGEPYNTNTTQLVIKLRDINNTPPTLRLPRATPSVEENVPDGFVIPTQLHATDPDTTAELRFEIDWQNSYATKQGRNTDSKEYIGCIEIETIYPNINQRGNAIGRVVVREIRDGVTIDYEMFEVLYLTVIVRDLNTVIGEDHDISTFTITIIDMNDNPPLWVEGTLTQEFRVREVAASGVVIGSVLATDIDGPLYNQVRYTITPRLDTPEDLVDIDFNTGQISVKLHQAIDADEPPRQNLYYTVIASDKCDLLTVTECPPDPTYFETPGEITIHITDTNNKVPQVEDDKFEATVYIYEGADDGQHVVQIYASDLDRDEIYHKVSYQINYAINSRLRDFFEMDLESGLVYVNNTAGELLDRDGDEPTHRIFFNVIDNFYGEGDGNRNQNETQVLVVLLDINDNYPELPETIPWAISESLELGERVQPEIFARDRDEPGTDNSRVAYAITGLASTDRDIQVPNLFNMITIERDRGIDQTGILEAAMDLRGYWGTYQIDIQAYDHGIPQRISNQKYPLVIRPYNFHDPVFVFPQPGSTIRLAKERAVVNGILATVDGEFLDRIVATDEDGLEAGLVTFSIAGDDEDAQFFDVLNDGVNSGALTLTRLFPEEFREFQVTIRATDGGTEPGPRSTDCLVTVVFVPTQGEPVFEDRTYTVAFVEKDEGMLEEAELPRASDPRNIMCEDDCHDTYYSIVGGNSGEHFTVDPRTNVLSLVKPLDRSEQETHTLIIGASDTPNPAAVLQASTLTVTVNVREANPRPVFQRALYTAGISAGDFIERNLLTLVATHSEDLPITYTLIQESMEADPTLEAVQESAFILNPETGVLSLNFQPTASMHGMFEFEVKATDSRTETARTEVKVYLISDRNRVFFTFNNPLPEVTPQEDFIAETFTAFFGMTCNIDQSWWASDPVTGATKDDQTEVRAHFIRDDLPVPAEEIEQLRGNPTLVNSIQRALEEQNLQLADLFTGETPILGGDAQARALYALAAVAAALALIVVVLLIVFFVRTRTLNRRLQALSMTKYSSQDSGLNRVGLAAPGTNKHAVEGSNPIWNETLKAPDFDALSEQSYDSDLIGIEDLPQFRNDYFPPEEGSSMRGVVNEHVPESIANHNNNFGFNSTPFSPEFANTQFRR

SEQ ID NO: 217 - protein, 1014 aa, Helicoverpa zea
MANRWYTLLLGAALLQSVLSFGPIEVTDDEWAEYRNLMRDPAYRLPTTTKPSNYAVNLTPHFTGTTLAFTFEGSVRITITATQANVNEIVLHCNDLTIESVMVATEASPNVNLIASGQTFVCDPVYSFLRIRTASALNIDTNYIITSNFRGNLQTNMRGFYRSWYVDSSGTKRWMATTQFQPGHARQAFPCYDEPGFKATFDITINREADFSPTLSNMPIITTTPLATGRVAETFHTTPETSTYLIAFIVSHYSQVASNNNLQRPFHIYARDNVGVHGNFALEIGVPLLEVMERYTEIPYYGMAQNMNMKQAAIPDFSAGAMENWGLLTYREALILFDPVNTNNFYRQRIANIISHEIAHMWFGNLVTCAWWDNLWLNEGFARFYQYYLTGVVAPEMGFETRFIVEQLHVSMLSDSLDSAHALTNPNVNDPTTVSAHFSTITYAKGASIIRMTQHLLGNNTFVKGLRTYLKDNAYGVAEPRHLFTVLDAAATADNALANYGGMTIDRYFRSWSEKAGHPLLTVSIDHSSGRMTIIQTRFERNTGVSTATDSLWDIPITWTRAGSIDFDNLKPTQFISGVLTIIDRGTTGREWVIFNKQQTGFYRVNYDQITWGLITQALRSNVRLSIHEYNRAQIVDDVMLLARAGIMTYSRALNILSFLKFEDQYAPWGAAITGFNFALRRLAHDVTAHQKLRNEILDLSTAIVNRLGFSEPAVSNFMDDLLRMNVMTFLCDIGHQGCITVARTSFATWKNGGVVPPNMRPWVYCNGVRYGDQSDFTHLWNRYTASDVANDKLVMLSAAGCTLNQASLNIFLNAIVSGSDDIRPQDHSAAIAAAVRSNEVNTMRVFTWLQANVQQTINTLGSVSPILNEITARLLNEAQITQVQTWLNANQNLIGTAAHTSATNGIATSRSNIQWYTQRVPEFNVYFETGYVEENFADTTTTSTTTTTTTTTTTTAAPTTTTTTEAPATTTTTTTGAPTTTTTEATTTPVPGSANIATLSIVTMIVTLVVNMA

SEQ ID NO: 218 - protein, 1040 aa, Helicoverpa zea
MQFITIILLASAAIISADFPLPPEFDEPEFFSSSDPDSYRLPEDLDPINYVVEVTPYFTATDTKEAFTFDGIVTITLRTLKADLNALIIQENVRTINSVALTTEAGTTVPLHATNPFERISAYHFLKVNLPAGATLENGAVYKLTVDYVGNINETPLSRGVFRGSHKDANGNIRWYAATHLQPTNSRQAFPSFDEPGFKSTFDIIINRPVTFAPSFSNMGIRSSDLVNNRIREVFYTTPRMSAYLVTFHISEDFTVIADNNNEARSYRILARPTAAGQGQYALEVGPPVTNWLGEYLGIDYYSMDENTNMKNDQIASPYWASGATENWGLVTYRELRLLYQEGETNALDKMYIGTITAHELAHKWFGNLITCRWWDNVWINEGFASYFEYFAMDGVDKSMELEDQFNIMYVQSALSADATLSTRALQHTVNSPTEVTGHFSGISYSKGASLLLMLKHFLTENTFKKALNIFLEARKFEHAFPADLYSAFATAVQQDGVPSNTFDIASFMKYWVEEPGYPVLEVSVNSAAGRIELSQKRFLVSATATPTDQVWPLPLTYTTESNPDWQNLLPSKVMTAKTDFIERTVGANEWVIFNVQQKGIYRVNYDTRNWELLAAALSRDHTAIHHLNRAQIVDDVFALMRSGQITYRLGFKVLDFLKKDTSYYSWYPAITGFNWLRNRFLHLPTTLAAFDEILYGFLDAVITDLGYDVVANEPLTRTLNRFFTLSFACNIGHKGCVDNAVQKFVALKDNSVAVNPNLRRHVFCEGLRAGGLDEWQFLYNRRQASNNQGDEVAMLRSLGCTSNTAAGQAYLKMILEDDDVKAQDRVNAFSFFYMGHRDNAKAGLQFLKDNVDAIRKAVVLPAWFNNVLTTTASYLDEAGLKDMEEWLLANQNAVPEFAVGINAITSARNNMQWGSDNAATIIAAANDEDPPEDGGSGEEVDPTPAPTTTTTEAPTTTTTEAPTTTTTEAPTTTTTEAPTTTTTAEPTTEGSGEESTTPDGSSTTAAPESGESEEDESSSAAIFLPTTVLLSWTVLAMLL

SEQ ID NO: 219 - protein, 1013 aa, Helicoverpa zea
MAAIKLLVLSLACACVIAHSPIPPVSRTIFLDERLEGGAFENIDAFKNIELSNAAASPYRLPNTTFPTHYKVLWVINLSDNEQTYSGTVDITLQATQPNVNEIVIHCDHLTVTSVVLRQGTATEGTLIPTTPTPQSQYHFLRVALNDGVLLYNENVPVQYTLSIAFNAEMRDDMYGIYRSWYRNLPTDNNIRWMATTQFQATAARYALPCYDEPGYKAKFDVTIRRPLGYKSWFCTRQRITRPSTTGYAEGEYHTTPEMSTYLLALIVADYDSLATLDANDRVLHEVIARPGAIINGQAAYAQRAGQDLLGNMSDHTGFDFYKQDENLKMTQAAIPDFGAGAMENWGLLTYREAYILYDEQHTSSNFKQIIAYILSHEIAHMWFGNLVTNAWWDVLWLNEGFARYYQYFLTAWVEDMGLATRFINEQVHASLLSDSSIYAHPLTNPGVGSPAAVSAMFSTITYNKGASVIRMTEHLLGFEVHRAGLRKYLEDMKFKTVQPIDLFTALETAGNDAGALDAYGDHFDFVKYYESWTEQPGHPVLNVHINHQTGHMTIYQRRFDIDTGYSVQNRNYIVPITFTTGADPDFSNTKPSHVISKAVTVIDRGVVGDVWTIFNIQQTGFYRVNYDDYTWDLIILALRGADREKIHEYNRAQIVNDVFQFARSGLMTYERALNILPYLENETDYAPWVAAITGFNWLRNRLVGKPQLAELNAKIVQWSSKVMSELTYMPIEGEPFMRSYLRWQLAPVMCNLNVPACRAGARVIFDNLRLHQHEVPVDSRSWVYCNALRDGGAVEFDHLYNRFKAHNDYTEKILILQTLGCTSHPASLTTLLNDIATPNNIIRPQDYTTAFSTAVSGNEENTLFVLNYIQNNLETVLKAFTSPRTPLSYIAARLRTVEDVTAYQTWLNLTTTREVLGTSYNNIYGDSVAAYNSILWVATVEDSLSAYLTNGDNVIQPTTSTTTTTVAPTTVTQPPITEPSTPSLPVPVTDGAMTSFASLFIISLGAILHLIL

SEQ ID NO: 220 - protein, 951 aa, Helicoverpa zea
MGAKMLLPTVFCILLGSIAAIPQEDFRSNLEWSDYSTNLDEPAYRLRDVVYPTDVNLDLDVYLNHLNFSGLVQIDVQVRENNLRQIVLHQKVVSITGVNVVGPNGPVPLQFPHPYTTDDYYEILLINLDQPISIGNYSITIRYNGQINANPLDRGFYRGYYYLNNELRVYATTQFQPYHARKAFPCFDEPQFKSRYTISITRDTSLSPSYSNMAIRSAQDVSTSRIRENFYTTPIISAYLVAFHVSDFVSTEYTSTDAKPFSIISRQGATNQHQYAAEIGLKITNELDDYFGIQYHEMGQGALMKNDHIALPDFPSGAMENWGMVNYREAYLLYDANNTNLNNKIFIATIMAHELGHKWFGNLVTCFWWSNLWLNESFASFFEYFGAHWADPALELDDQFVVDYVHSALNSDASQYATPMNHTDVVDNDSITSHFSVTSYAKGASVLKMMEHFVGWRTFRNALRYYLRNNEYDIGFPVDMYTAFKQAVAEDFTFQRDFPNVDVGAVFDSWVQNPGSPVINVARNNNTGVITVNQQRYVLSGAVAPTTWHIPLTWTQHGSLNFNSTRPSTVLTNEIGTINAASGDHFVIFNIAQSGLYRVNYDTNNWQLLASYLKSNNRQNIHKLNRAQIVNDILYFVRSNSINRTLAFDVLDFLRDETDYYVWNGALTQIDWILRRLEHLPTAHAAFSEYILELMNTVINHLGYNEHSTDSTSTILNRMQIMNYACNLGHSGCISDSLDKWRQHRANVSNLVPVNLRRYVYCVGLREGNETDYNYLYSVYNSSENTADMVVILRALACTKHQPSLEHYLQQSMYNDKVRIHDRTNAFSFALQGNPENLPIVLNFLYNNFAAIRETYGGVARLNICLNAIAAFLTDYQTITQFQTWVDSNQLELVGSVSVGNNVVTAALNNLTWGNGAAVEIVNFLNSRSGSTTILASSILILAAMLLQMFR

SEQ ID NO: 221 - protein, 535 aa, Helicoverpa zea
MVTLFPYVVAVLCGATSARAHWLHPAAPAAASRAETSANYWAQDAQAAINARLERVESVKKARNVIMFLGDGMSVPTLAAARTLLGQRQGKTGEETKLHFETFPTIGLVKTYCVDAQIADSACTATAYLCGVKNNYGAIGVDGTVRRGDCQAASNTATHVESIAEWALADGRDVGIVTTTRITHASPAGTFAKTANRTWENDGEVSQMGLDAKDCPDIAHQLVHHHPGNKFKVIFGGGKRAFLPNTEQDEKRSYGRRIDNRNLIKEWEDDKVSRNVSHQYVWHREQLMRLKEDLPEYMLGLFESSHMTYHLKSDPQSEPTLAELTEVAIRSLRRNEKGFFLFVEGRRIDHAHHDNLVELALDETLEMDKAVATATEMLSEDDSLIVVTADHAHVMTFNGYSNRGHNILGPSRDVGLDNVPYMTLTYANGPGFRPHVNDIRPDVTLEPNYRTLDWESHVDVPLVDETHGGDDVAVFARGPHHSMFTGLYEQSQLPHLMAYAACIGPGRHACASAAHLPSAHFVVALLALFTSILLR

SEQ ID NO: 222 - protein, 535 aa, Helicoverpa zea
MVTLFPYVVAVLCGATSARAHWLHPAAPAAASRAETSANYWAQDAQAAINARLERVESVKKARNVIMFLGDGMSVPTLAAARTLLGQRQGKTGEETKLHFETFPTIGLVKTYCVDAQIADSACTATAYLCGVKNNYGAIGVDGTVRRGDCQAASNTATHVESIAEWALADGRDVGIVTTTRITHASPAGTFAKTANRTWENDGEVSQMGLDAKDCPDIAHQLVHHHPGNKFKVIFGGGRRAFLPNTVQDDEGSYGRRIDNRDLIQEWKNDKDSRNVSHQYLWQREQLMNLNDDLPEYMLGLFESSHMEYHLKSDPQTEPTLAELTEVAIRSLRRNEKGFFLFVEGGRIDHAHHDNLVELALDETLEMDKAVATATEMLSEDDSLIVVTADHAHVMTFNGYSNRGHNILGPSRDVGLDNVPYMTLTYANGPGFRPHVNDIRPDVTLEPNYRTLDWESHVDVPLVDETHGGDDVAVFARGPHHSMFTGLYEQSQLPHLMAYAACIGPGRHACASAAHLPSAHFFVALLALFISILLR

SEQ ID NO: 223 - protein, 1295 aa, Spodoptera frugiperda
MLTFMEVPRKRTMVEAGSLEERFRLIPTSTNTTPNKDSKGNAWQLKPGEKENENKLPDPLNEDVQKGQFSDTSSEPSEAKAEEVPSIPFITLFRFASTRDKLFIICALICSAVAAVSTPLNTLLLAYLLEAMVNYSIFGDADAFMKSLLNFAIYNAAVGAALVVLSYAATTLMNIAAYNQVYVIRQEYLKAALNQDFGYFDVHKNAEIANKMNSDIMKLEEGIGEKLATFFFYQASFLSSVIMALVKGWKLALLCLISFPVTMTLVGVAGLIAASLSKKEAIATGKAGAIAEEVISAIRTVYAFSGQEKELDRYEGHLNDARKINVKKSLFNGLAMGCLFFCIFCAYALSFWFGYRLMVTDGYDVSTMIAVFFGVMTGSANFGISSTLMEVFGSARGAGAHIFNMIDNVPTINPLQNRGTVPSDIEGNIELKNVEFHYPSRPDVPVLKGVSIKVKRGQSVALVGHSGCGKSTIIQLISRFYDVVEGSVAIDGNDVRDLSVRWLREQIGLVGQEPVLFNTTVRENIRYGRENATNEEIEACARQANAHQFIMKLPKGYDTLVGERGASLSGGQKQRIAIARALVRNPKILLLDEATSALDTSSEAKVQKALDKAQEGRTTIVVAHRLSTIRNVDVIYVFKAGLVVECGNHTELMASKGHYYDMVMLQNLPGVDEQSPEKTKLSRETSIISEKDDEDEFLEFRNDDKEEDAAEAPDISFMRVLKLNKPEWKSVTLASICSLMSGFCMPLFAVIFGDFLALLDGDDPDEIQKGVSRLALIFVGIGVFSGITNFIVVFFYGIAGEALTKRLRLMMFRKLLEMDIGFYDDKDNSTGALCARLSGEAAAVQGATGQRIGTVVQAVGTFGFALVLSLIFEWRVGLVALTFVPIIIFVLYKEGRMTYAATSGTVKVMETSSKIAVEAVANVRTVASLGREETFRREYSKQLRPALDTAVRSSHWRGLVFGMSRGVFNFVIASSLYYGGTIIVNEGVPFEQVFKSAQALLMGATSAAQAFAFAPNFQKGIKAAGRVIVLLGRQSKITDPAEPAVKHFNGTGEASLQGIQFRYPTRPLVRVLKDLNLEIQRGKTVALVGASGCGKSTVIQLLERYYDPEDGIVAQDGVPLPKLNLVDARRAIGFVQQEPILFDRTIGENIAYGNNEARVSNDEVIEAAKQANIHNFITSLPLGYDTNIGSKGTQLSGGQKQRVAIARALIRRPKMLLLDEATSALDTESEKVVQEALDKAKAGRTCVMIAHRLSTVRDADVICVIHEGQVAEMGTHNELLELKGLYYNLNRRGYA

SEQ ID NO: 224 - protein, 1305 aa, Spodopterafrugiperda
MGTKKKKEQKKEPEQTLSYYQIFRYATCTELMATILGIIFGLASGGGVCYNLVQIGELSTAFVERTTYTERLTSYLPLTAAFGGGRRLFNASYEENMLALIEDAKAMAIGLFLSIGVSLIFCMLSVGLISWSALRQITRIRMKFLNAVLRQDMSWFDTDSEFNLASKMSENLMSLKEGMGDKLAVVSNLVGTAIICLCTAFPLGWELTLACVSVMPFSIAVSIILTNYQTKSSILEMESYSQAGKQAEEVLKSVRTIVAFNGENKEVDRYTKLLQPAEKQGRKRGLYTGLGNGFNWVLTYSLNAIGFTYGTRLVFMDWDSPDGERKYLVGVVYSILFSVYMATQSVTFCVPHAEVFAAARGAASSIFQLIDRVPLIDSLQKGGLTPRRVIGDISLEDVHFSYPSRPEVKVLNGFSIKIKAGECVALVGSSGCGKSTILQLLQRLYDPLSGSVKLDGKDVKNLNLGWLRSCLGVVGQEPVLFRGTIFENIAIGFPEATREEVQTVAEMAYAHDFITNLPNGYDTVIGERGASLSGGQKQRIAIARSLLREPAVLLLDEATSALDPHSERQVQAALDRASVGRTTIMVSHRLSTITNANRIICMDQGAIVEEGTHEELMKTKGFYYKLVTTGTETKEPEEIETVAEEGDGEENGEPVLAPRADVKRKSNRRVHRHHSIKKDSHDWMTPRGSICSVVSTGLQNFVYNADYESDEEKDEEEEVKPVSDWQILKLNAPEWPLITVGSIAAFIQGACFPVFALLFGFSSGIFVLDDRKEIIYLADLYSGMFIVVAAVAGVSMCLQSTTFTTAGLKMTTRLRQQYFSSLLKQEIGFFDKESNTVGAMCARLSGDTAEVQGATGLRIGLILQGISSVLVGFLMAICYNWKLTLVGTVFLPLMVGSIWLEGIVSQQSQINERTAMEAATAIATEAVVSIKTVQSLGVELVFLKKFEEALNEACAAVSKKTRWRGLVLGLGVYVPFMAFCSATVYGAVLVAYGEIEYKIVMLVNEAIMYGAYMLGQSLVYVPSFNSAKTCGARILALIKRTPRVKTEDGIRDKKDWAATGNFSIRDVEFSYPTRPHLRILKGIDLKVDAGKTVALVGSSGCGKSTVLQLMQRFYDPDSGNIELDSRDIRSSLTLPRLRRQLGVVQQEPILFDRTLAENIAYGDNNRKVTMHEIVAAAKAANIHSFIVSLPKGYDTNLGSGGAQLSGGQKQRVCIARALIRSPRLLLLDEATSALDANSERAVSEALEKAAKGRTCITIAHRLSTIKDADLICVLDKGKIVERGTHAELFNQRGYYWRMCKGQNMA

SEQ ID NO: 225 - protein, 1266 aa, Helicoverpa zea
MKDSDGNGRQLKPGDKENGNKLPDPLNGEFPKGKDSDTSSEADSKADEVPSIAFITLFRFATKKDKIFIVCALICSVVAACSTPINTLLLAFLLDAMVEYGSSIRDGTPDPDTFLEALMFFAIYNTVTGVVLIILSYAATVLMNIAAYHQVHVIRQEYLKAALNQDFAYYDIHKNADIASKINSDVVKLEDGIGEKLATFVFYQAAFFSSVIMALVKGWKLALLCLISFPVTLTLVGVAGLVGARFGKKEAIASGKAGAIAEEVISAIRTVYAFSGQSKEMVRYEGHLREARKINIKKGFFNGLAMGLLFFCIFCAYALSFWFGYRLLSTDDDYDISTMIAVFFGVMTGSANFGISSTLMEVFGSARGAGAQIFNMIDNIPTINPLLNRGTTPPNIQGNIELKNVIFHYPSRPDVPVLKGINISVKRGQSVALVGHSGCGKSTIIQLISRFYDVIDGSVAIDGHDVRDLSVRWLRDQIGLVGQEPVLFNTTVRENIRYGRENCTNEEIEACARQANAHQFIMRLPKGYDTLVGERGASLSGGQKQRIAIARALVRNPKILLLDEATSALDTSSEARVQKALDKAQKGRTTLVVAHRLSTIRNVDVIYVFKSGVVVERGNHDELMSQKGHYYDMVMLQNLGAEDTNDKSRLMRETSETSVEDEEDEEEFLDFKTGDTEDDVDNVPDISFWRVLRLNKPEWKSVSLASICSLMSGFSMPLFAVIFGDFLAILSDPDPAVVLNEVRKIALIFVGIGVFSGITNFIVVFFYGIAGEYLTERLRQMMFKKLLEQEVGFYDDKDNSTGALCARLSGEAATVQGATGQRIGTVVQAVGTFGFALVLSLVYEWRVGLVALTFVPVIVFVLYKQGRMTYKASFGTAKTMEKSSKIAVEAVANVRTVASLGREDTFRREYEKQLNPALQEAIKASHYRGLVFGLSRGIFNFVIAASLYYGGTLIVSEDIPYDVVFKSAQALLMGSSSAAQAFAFAPNFQKGIKAAGRIIMLLNRQSKITDPVRPAVHNFKGTGEASLQGIKFCYPTRPMIQVLKGLQLEIQRGKTLALVGASGCGKSTVIQLLERYYDPDEGIVAQDGVPLPKLRLVDSRRAIGFVQQEPILFDRTIGENIAYGNNEQKVTQDEIIQAAKQANIHNFISSLPLGYDTNIGAKGTQLSGGQKQRVAIARALIRRPKMLLLDEATSALDTESEKVVQEALDAAKAGRTCVMIAHRLSTVRDADVICVIHDGLVAETGTHTELIERKGLYYNLNRRGYA

SEQ ID NO: 226 - protein, 1260 aa, Ostrinia nubilalis
MKSKVYDLNGTGKEKNGGLPTPDFVPKDKKNNDSEPEPTPEEVPSVSFFSLYRFARTQDKCYIAVGIICSILSGCCTPLNTLLFASLLQSMVDYGISLQIGQPDPDSFKTAFTEFAIYNCIVGAALVILSYTATVLMNIAAYNQVYKIRQEYLKAALNQDFKYFDVHQTGDFAVKMTNDLVKLEDGIGEKLGTFIFYQAAFVSSIIMALVKGWKLALLCLISFPITLTLVGLAGFIASKLSKKEAVAAGKAGSIAEEVISSVRTVYAFSGQQKEIDRYQLHLADSRKINIKKGFYNGVAMGVLFFCIFCSYALSFWFGYKLMVEEPENYDVYTMIAVFFGVMMGSANFGISSTLMEVFGSARGAGAQIFNLIDNVPTINPLLDAGTKPPSIDGNIELKDVVFQYPSRPDVPVLKGVSLKVSRGQSVALVGHSGCGKSTIIQLISRYYDVVGGSVLVDGKDVRELSVRWLRDQIGLVGQEPVLFNTTVRQNIRYGRESVTDEEIEAAARQAFAHQFIMKLPKGYDTLVGERGASLSGGQKQRIAIARALVRNPSILLLDEATSALDMASEAKVQKALDKAQEGRTTIVIAHRLSTIRNVDVIYVFKNGTIVESGNHEDLIKAKGHYYDMVMMQTFPGSEDDAEIVKQLTREVSVISEKDDEEEIVGGSGGEVVEAEEENTEVSFWKVVKLNKPEWKSVSLASLCSFVSGFSMPLLAVILGDFINVLSNPNPDEVLPEVRRFALIFVGIGVFSGITNFITVFFYAIAGEYLTERLRKVMFHHMLQQEIAFYDDKNHSTGALCAKLSGEAAQVQGATGQRIGTVLSAIGTFGFALVLALIYEWRVGLVALAFVPLMAGILYKEGRMVSAESFGTAKTMEASSKIAVEAVSNVRTVASLGREGQFLKDYATQLLPALHLAKRSAHWRGIVFGLSRGLFNFIYAAAMYYGGIRIIYYGVDFALVLKSAQALLMGASSAAQAFAFAPNFQKGIKAAGRVTGLLNKRSKITDPANPIENFKGTGEASLQEVNFRYPTRPLIQVLKNLNLEVERGKTVALVGSSGCGKSTVIQLLERYYDPDDGIVAQDGTPLPKLRLADARKAIGFVQQEPVLFDRTIGENIAYGDNSRRVVMDEIIHAAQQANIHNFITSLPLGYDTNIGSKGTQLSGGQKQRVAIARALVRRPQMLLLDEATSALDTESEKVVQEALDAAKAGRTCVLIAHRLSTVRDADVICVLSEGRVAESGTHAELLQLKGLYYNLNKSGYT

SEQ ID NO: 227 - protein, 565 aa, Trichoplusia ni
MRSIVTLLVLVAACGALADRYHPAEPAERAGPAGRASPAELLGSHWRAQAQDALKERLARPANRNKARNVIMFLGDGMSVPTLAAARALLGQRQGATGEEAQMTFESFPTSGLSKTYCVNSQVADSACSATAYLCGVKTNQGLLGVDASVQRHNCESSIDTARHVESIAEWALADGRDAGIVTTTRITHASPAGVFAKTANRNWENDAEVKAANQDINACPDIAYQLIHKHPGNKFKVILGGGRRNFLPTTVTDEESQAGRRTDGRNLIEEWQQDKAARGVSFKYVWNVSELLQLNDNLPEYLLGLFESNHLQYHMQANLNTEPTLEQLTETAIRMLNRNEKGFFLFVEGGRIDHAHHDNLAHLALDETLEMDKAIKRAVDLLSEEDTLIVVTADHAHVMSYNGYSRRGNSILGPSRDTDENNVPYMTLSYTNGPGFRPHVNGKRSDVTQENGFGTLTWKSHVDVPLDSETHGGDDVAVFARGPYHMLFTGLYEQNQIPHLMAYAACIGPGLHSCAEADTTSTPEANPSEATTASPTTAEPSAAAPVSATLALFALLTTLTLLLH

SEQ ID NO: 228 - protein, 982 aa, Trichoplusia ni
MANRFTLLLLGVALAQGILAYSPIEMPEDEWQEYRNLMRDPTYRLVRTTEPETYKVTLTPYFDTNDAKAFTFDGEVEILIKANQAVSEIVLHCNDLTISKLTVTTETSTTDLAEAGQTFTCEANTSFLRIKTTSPLEAEAKYVIKSEFTGNLQTNMRGFYRSWYVDSSGNKRWMATTQFQPGHARQAFPCYDEPSFKALFDITIKRLPDFSETLSNMPIKTRGPLTDGRIAETFHTTPKTSTYLLAFIVSHYKEVATGTDLNRPFKIYARDNAKLTGDWSLDIGERLLEEMEKITDVPYYGMALNMDMKQAAIPDFSAGAMENWGLLTYREALILYDPKHSNHFYKQRVANIVSHEIAHMWFGNYVTCAWWDNLWLNEGFARFYQYYLTDRVDKNLGFDTRFIVEQLHTSLLSDSGVNAHPLTDENVSSPTTVSAHFSTITYAKGASVLRMTQHLLGNSTFEKGLRSYLKARRYDVATPDDLFDALQEAATLDGALTQYPGATVKAYFETWTSKAGHPLLTVTVGNDGTMKVTQERFGLTPVTTFEGTWQIPITWTSQGNVDFYDLKPSRILTGTSTTIDVGTDQRGWLIFNKQQTGFYRVDYDPITWAHNTMALRNAEVRKDIHVYNRAQIVDDVFLLARSERMTYRQAFNILSFLEFEDEYAPWIAAIAGFNFAVRRLAHDEAALAKLQAHIHSTAAAVVNRLGYEDKGGDDNFMDDLLRMNLMQFLCNVNHEKCIEEGVKSFQSWKANEAFHIPANHRPWVYCAGLRAGDASDFDVFWSRYLKEDLASEKVVMVTAAGCTGDEASLRKFLNAIVDDKEDIRPQDYSVALNSAIASNEVNTLRAFEWLKTNVDQTVKTLGSINSPLSTISSRLLNDAQINTVETWLNENAEIIGASAVAAGRSGIATSKSNIEWLTKRKVEFEDYFETGFEDPLAPPVTETEASTSSPTAAPSTTEAPASASTAALSVVAMLVTLAVNMV

SEQ ID NO: 229 - protein, 940 aa, Trichoplusia ni
MSQTLLWALGLALLAVAKADNPISYYIESQDFPFDEIPEDTISRNDQRVYRLPTSVVPVEYDIHINLFFAERTEKPFSYEGFETIIVEAKEEVNEIVLHANVDRIQSISVFDSTGRPLRLQRFNPFHTEKVYHFLKINLAETLAVGAKYTLHINYEGTMNVGPMKRGIWRGWYVDSNNVERIYATTHFQPYNARQAFPCWDEPYFKAIFKLHLSSPSGYTGTFSNTAIEQTVSLPNNRVRVDFAPTPKMSSYLVTFLVSESFQVIAQDTSFDPPIRIIGRSNTNGLADHALDLAVKMTKYFDSYFEIPYSSLSPNLLNDHISSPDWASAGTENWGMVSYRELYLILSEEETLMSVEHYAATLVSHELAHKWFGNLITCHWWSNTWINEGYASYFGYIATHEMFPKYEFPDHFNTRYLQTSLSFDSGVSTVPLNHDVNTPAQVTGHFGTISYSKAAAFLRMTANIMSPETFRKSCKLFLQSNAYSPTDPDDLLKSMLEAIEEDNSLADYGSFSFADYYNIWVNEPGYPILNVTVNHTTGVISLSQERFFLSSSAAPTGQIYPIPITFSTKTNPSFSILKPSHIMTGATLTINKAAVEEWVIFNNMQHGHYRVNYDSKTWSLIAEALLEEPSPIHILNRAQIVDDVFALMRSNRMTHNDGFKILKFLAKETSIHIWSPAISGFTWLRNRLRHLPAKQAEFDAFLLSQMEHAINELGYEPKPNETPTITMARQDILQFACTLGHEKCNQDSWERFVNLRDNGVPINARIRRNVYMTAMRKGNQRDFEYLLNRFRSSNYANDQLEMLRGMGASTDPELLTRYLALTLQKAVRTHDKLNSFNYALLGNNENVKTVVMFVKHNIDQIRTAYVEDSPANPVHSALSNIAAYLDEDGLDDYEHWLRTTQSGIPQFNSAISGINSARNNIAWGTANADVILAAARGSAA

SEQ ID NO: 230 - protein, 1733 aa, Trichoplusia ni
MEADVRITTAALLLFAASFVNAQNDGLRCTYMKEIPRGETPVFEIKDFDGVPWNQQPLIPLPQREELCIEDPAFAGNSIVMTIFMEEEIEGEIAIAKLNYKGTETPSIRQPFASGSFHMLGPVIRRIPEDGGDWHLVITNKQDYEAPDMQRYSFDISVPSESAVLIVMLDIINIDDNAPIIHMIDRCEIPEPGELGRTSCVYTVTDADGRLSTEFMTYEIESDRDDADYFELVNDHTIDPDDKTTHMVLYLHKALDFELNPLHIFRVTALDSKPNTHTVTMMVQVLNVDRRNPRWLDIFAVQQFDEKTVQRFHIRAIDGDTGLDREIYYKLEADEEDTFFSLEPIAGDRSGATLVVDKIDRDTLQREVFQLSIVAYKYGIDDKEGKNPFETRANIVIIVNDVNDQRPLPFKNTYTIEIDEETPMTLNLEDFGFHDIDLGENAQYEVFLESVYPEGAEEAFMISPTRGYQEQSFIVSTRNHHLLDYEVEKYQNIQLKVKAIDLNDTRLTGEALLNINLRNWNDELPIFEHSAQTVDFDETVGKDFPVAIVKADDRDIGDKVVHSLLGNAEDYLTIDPDTGEISVAHDDYFDFHRQNEFFVQVRATDTLMEPYNSVTAQLTIRLRNINNTPPTLLLPRGSPEVEENVPQDFVIPAEIAATDPDLDAQLEFEIDWESSYATKQGRPAPDVEFHKCVEIITIPTETRHRVIGRLDVRTIREGVTIDYEEFEILYLSIKVYDRNTVAGAIDHAESILAINIIDMNDNPPVWAAGQLRQALRVREGSPAGGIIGSLLATDIDGPLYNKVRYSIHPKPGTKEGLVAIDPILGQLTVLGDGEIDADVPKTWTLEYTVIASDRCVEDDGVACTGTDPTVWNTEGDLSIDIIDTNNKNPETASPSITVWVWENATHGDPVAQLSATDLDRDELYHTVRYQILYSVNPMLLELFAVNQDSGLITVHYTTDTVLDRDGDYPEHTIFLNLFDNFFFDGDGQRNMAEKRVLVVLLDVNDNAPELPLPEELSWSVSEDEREEVRVLPHIYAPDRDEPDTDNSRVGYAILGLKVTNREIEVPELFNMIQIENKTGELETARHLKGFWGTYSIHIQAYDHGIPQQISEETYTLTIRPYNYHEPVFVFPQAGNTFRLSREQSTVNGVLVRVDGQSFPRVSATDGDGLHAGSVSFSVVGAAAEYFSMRNFEDNTGELYLSQPLPLEDDGFDITIRGSDAGTEPGSLFSEVSFRLVFVPTHGDPVFSVSQYTVAFIEKEAGLLESHQLPRAVDPKNYMCEEMNEPCHEIYYSIIDNNEEGYFQVGSTTNVISLSRELERASQASHVVRVAASNTLLDPAAPPPLLPSSTFLLTINVREADPRPVFEREIYTAGIYETDTSNRELLTVHATHTEGLDITYTMDLDTMVVDPSLEGVRESAFTLHPSSGVLSLNMNPLDTMVGMFEFDVVATDTRGAEARTDVKIYLITHLNRVYFLFNNTLDVVDSNRAFIADTFSSVFSLTCNIDAVLRAPDSSGAARDDRTEVRAHFIRDHVPATTEEIEQLRSNTILLRAIQETLLTRELHLEDFVGGSSPELGVDNSLTIYVLGALAALLGFLCVLLLITFIVRTRALNRRLEALSMTKYGSVDSGLNRVGLAAPGTNKHAVEGSNPIWNETIKAPDFDAISDVSNDSDLIGIEDLPQFRNDYFPPADDSSLRGIVLDNQNNDTVATHGNNFKFNASPFSPEFGNTPIRR

SEQ ID NO: 231 - protein, 1733 aa, Trichoplusia ni
MEADVRITTAALLLFAASFVNAQNDGLRCTYMKEIPRGETPVFEIKDFDGVPWNQQPLIPLPQREELCIEDPAFAGNSIVMTIFMEEEIEGEIAIAKLNYKGTETPSIRQPFASGSFHMLGPVIRRIPEDGGDWHLVITNKQDYEAPDMQRYSFDISVPSESAVLIVMLDIINIDDNAPIIHMIDRCEIPEPGELGRTSCVYTVTDADGRLSTEFMTYEIESDRDDAVYFELVNDHTLDPDDKTTHMVLYLHKALDFELNPLHIFRVTALDSKPNTHTVTMMVQVLNVDRRNPRWLDIFAVQQFDEKTVQRFHIRAIDGDTGLDREIYYKLEADEEDTFFSLEPIAGDRSGATLVVDKIDRDTLQREVFQLSIVAYKYGIDDKEGKNPFETRANIVIIVNDVNDQRPLPFKNTYTIEIDEETPMTLNLEDFGFHDIDLGENAQYEVFLESVYPEGAEEAFMISPTRGYQEQSFIVSTRNHHLLDYEVEKYQNIQLKVRAIDLNDTRLTGEALLNINLRNWNDELPIFEHSAQTVDFDETVGKDFPVAIVKADDRDIGDKVVHSLLGNAEDYLKIDPDTGEISVAHDDYFDFHRQNEFFVQVRATDTLMEPYNSVTAQLTIRLRNINNTPPTLLLPRGSPEVEENVPQDFVIPAEIAATDPDLDAQLEFEIDWESSYATKQGRPAPDVEFHKCVEIITIPTETRHRVIGRLDVRTIREGVTIDYEEFEILYLSIKVYDRNTVAGAIDHAESILAINIIDMNDNPPVWAAGQLRQALRVREGSPAGGIIGSLLATDIDGPLYNKVRYSIHPKPGTKEGLVAIDPILGQLTVLGDGEIDADVPKTWTLEYTVIASDRCVEDDGVACTGTDPTVWNTEGDLSIDIIDTNNKNPETASPSITVWVWENATHGDPVAQLSATDLDRDELYHTVRYQILYSVNPMLLELFAVDQDSGLITVHYTTDTVLDRDGDYPEHTIFLNLFDNFFFDGDGQRNMAEKRVLVVLLDVNDNAPELPLPEELSWSVSEDEREEVRVLPHIYAPDRDEPDTDNSRVGYAILGLKVTNREIEVPELFNMIQIENKTGELETARHLKGFWGTYSIHIQAYDHGIPQQISEETYTLTIRPYNYHEPVFVFPQAGNTFRLSREQSTVNGVLVRVDGQSFPRVSATDGDGLHAGSVSFSVVGAAAEYFSMRNFEDNTGELYLSQPLPLEDDGFDITIRGSDAGTEPGSLFSEVSFRLVFVPTHGDPVFSVSQYTVAFIEKEAGLLESHQLPRAVDPKNYMCEEMNEPCHEIYYSIIDNNEEGYFQVGSTTNVISLSRELERASQASHVVRVAASNTLLDPAAPPPLLPSSTFLLTINVREADPRPVFEREIYTAGIYETDTSNRELLTVHATHTEGLDITYTMDLDTMVVDPSLEGVRESAFTLHPSSGVLSLNMNPLDTMVGMFEFDVVATDTRGAEARTDVKIYLITHLNRVYFLFNNTLDVVDSNRAFIADTFSSVFSLTCNIDAVLRAPDSSGAARDDRTEVRAHFIRDHVPATTEEIEQLRSNTILLRAIQETLLTRELHLEDFVGGSSPELGVDNSLTIYVLGALAALLGFLCVLLLITFIVRTRALNRRLEALSMTKYGSVDSGLNRVGLAAPGTNKHAVEGSNPIWNETIKAPDFDAISDVSNDSDLIGIEDLPQFRNDYFPPADDSSLRGIVLDNQNNDTVATHGNNFKFNASPFSPEFGNTPIRR

SEQ ID NO: 232 - protein, 450 aa, Trichoplusia ni
AGNTFRLSREQSTVNGVLVRVDGQSFPRVSATDEDGLHAGSVSFSVVGAAAEYFSMRNFEDNTGELYLSQPLPLEDDGFDITIRGSDAGTEPGSLFSEVSFRLVFVPTHGDPVFSVSQYTVAFIEKEAGLLESHQLPRAVDPKNYMCEEMNEPCHEIYYSIIDNNEEGYFQVDSTTNVISLSRELERASQASHVVRVAASNTLLDPAAPPPLLPSSTFLLTINVREADPRPVFEREIYTAGIYETDTSNRELLTVHATHTEGLDITYTMDLDTMVVDPSLEGVRESAFTLHPSSGVLSLNFNPSATMVGMFEFDVVATDTRGAEARTDVKIYLITHLNRVYFLFNNTLDVVDSNRAFIADTFSSVFSLTCNIDAVLRAPDSSGAARDDRTEVRAHFIRNHVPATTDEIEQLRSNTILLRAIQETLLTRELHLEDFVGGSSPELGVDNSLT

SEQ ID NO: 233 - protein, 982 aa, Pseudoplusia includens
MANRFTFLLLGVALAQGILAYSPIDLPEDEWLEYRNLMRDSNYRLPRTTEPETYKVTLTPYLEASDGVKQFTFDGQVEILIVAKEAVSEILLHCNDLQISVLTVSAQSADANLVEPGQTFNCEDNTSFLRIKTASPLVANSKYVIKSTFTGNLQTNMRGFYRSWYYDNSNTKKWMATTQFQPGHARQAFPCYDEPSFKARFDITIIRPTTFSDTLSNMPIKEKGTEVNGRIPETFHTTPKTSTYLLAFIVSHYVPVSTGTTPNRPFVIYARNNAGTTGDWSLDVGERLLDEMEKYTGIEYYKMADYMNMKQAAIPDFSAGAMENWGLLTYREALILYDPRHSNHFYRQRVANIVSHEVAHMWFGNLVTCAWWDNLWLNEGFARFYQYYLTHRVEPKLGYDTRFIVEQLHTSLLSDSSANAHPLTDESVSSPTTVSAHFSTITYAKGASVLRMTQYLLGVETYEKGLRKYLEDHKYDVATPDDLFNALQNAATDDAALSQYAGATVKEYFESWTQKPGHPLLTVAVNNDGTMQITQERFGLTPSTATQGLWHIPISWTRQGEVDFDNLKPSQILTATSIQVDVGTTERGWLIFNKQQTGFYRVNYDPTTWAHNTMALRNSEERAKIHEFNRAQIVDDVFLLARSERMNYRVAFNILSFLEFEDAYAPWIAAIAGFNFALRRFAHDEVALAKLQSHIHTAATAVVNRLGFEDKGGDDNYMDDLLRMYVMQFLCNAKHEKCVEEGVKLFQSWKADPQFHIPANHRPWVYCAGLRAGDASDFDVFWARYLAETLASEKVVMVTAAGCTGNEASLRKFLDSIVDDEEDIRPQDYSVALNSAITGNEVNTLRAFEWLKDNIGQTAKTLGSINSPLSTISSRLLNEEQINTVDTWLTAQATVIGTSAVNAGRAGIETSRNNIEWLNKRKSEFEEYFESGFDDPLVTPPAETTTPASTSAPTTTEAPASAHTAALSVVTLLVTLAVNMIN

SEQ ID NO: 234 - protein, 1733 aa, Pseudoplusia includens; identical to SEQ ID NO: 231

SEQ ID NO: 235 - protein, 1773 aa, Pseudoplusia includens
MEVDVRITTAALLIFAATLVSAQTNQLRCTYIQEIPRGDTPVFNFPSFDGVPWSQQPLLPLPQREELCMEDPVSAGSSVIMTIYMEEEIEEEIAIAKLNYKGTGTPEIGPAFTTGSFHTLGPVFRRIPEDGEWHLVITNKQDFEAPNMQRYWFDISVPGESVGLMVLLEIVNIDDNAPIVHMIDRCEIPEPGTHGRTACAYTVSDADGRISTEFMTYKIDSDRNDQDFFELVNDHTMDADEKITHMVLYLHKDLDFEVNPLHIFSVTAFDSKPNEHEVTMMVQVQNTDRRNPRWLDIFAVQQFNEKTTQRFPIRAIDGDTGIDRQIHYRLEADEEDTFFSLELAADGNGAVLVVDEIDRDTLMREVFQLSIVAYKYGPNDEEDRPSFETRANIVIIVIDVNDQRPIPFKQIDDDNNNDDGDDSSDDDEDSSADSSRNELAPEVPEDPTIRIYKITIEEETPMTLNLQDFGFHDRDLGENAQYEVHLESISPEGAEEAFSISPTRGYQDQSFIVSTRNHRLLDFEVEEFQKIRLRVIAIDLNDTSLRGEAWLHIDLENWNDEMPIFGQDVYTAEFDETVGEGFPVATVRATDRDIGDRVVHSLLGNAGDYLTIDPDTGEIFVAHDNYFDFHRQNEYFVQVRATDTLLDTNNTATAQLTIKLRNINNTPPTLLLPRFSPEVKENVPEDFVIPADIEATDPDLDAQLEFEIDWEQSYATKQGRPTPAIEFHNCLEIITVPTESRHRVVGRLDVREIRTGVTIDYEEFEILYLSIRVIDRNTVPGAIDYAESILAINIIDMNDNWPIWAAGQLQQSLRVREGSAAGVVIGSLLATDIDGPLYNKVRYSLVPIGETKPDLVTIDPIFGQLTVLTGGQIDADEPKTWALEYTVTASDRCVEDDGFPCTGDDPTVWNTEGYLCIDIIDTNNKSPETENANITVWVWENATEGDTVAQLSATDLDRDELYHTVRYQILYSVNLRLLNFFAVDLDTGLITVHYPTNEVLDRDGDEPEHTIFLNLFDNFYFDGDGQRNMAEKTVRVRLLDVNDNAPELPPPDELSWTVSEDEPAESRVLPEIYAPDRDEPDTDNSRVGYAILGLEVNRDIEVPELFTMVQIENVTGELETAMHLKGFWGTYTIHIQAYDHGIPQQVSEERYSLVVRPYNYHAPEFVFPQQGAVYRLSLEQSTVNGVLVQVSGQSFPRVTATDEDGLHAGAVTFSVVGAPGEYFSMRNFDDNTGELYLTQPLVNTELDITIRGTDGGTEPDSKFSELSFRLVFVTTLGDPTFAVEEHTVAFIEKEAGLLESFQLPTAVDAKNYLCEELNEPCHQIYYNFIEGNSQGYFQVEPTTNMISLTRELDRAVEARYVLRVGTSNAPIDPSAPPTLMAASTLLLTVNVREADPRPLFQRDIYSAGIYETDVTGKLLLTVHATHTEGLDITYSMDMETMEVDLSLEAVKDSALILHPTEGSLTLNMNPLENMVGMFEFDVVATDTAGATARTDVKIYLITHLNRVFFTFNNTLDVVDANREFIADTFSLGFSLPGFRLTCNIDAVLRATDSNGIARDDRTEVRAHFIRNNIPATTEEIEELRSNTLLINSIQETLFTRSLSLEDFVGGASPELEADNNLTVYVLSALTAMLGLLCLLLLVTFIIRTRALNRRLEALSMTKYGSVDSGLNRAGLAAPGTNKHAIEGSNPIWNETIKAPDFDAISDVSNDSDLIGIEDLPQFRSDYFPPGDDHSLQGIVLDNQNNDTVATHGNNFKFNASPFSPEFGNTPIRR

SEQ ID NO: 236 - protein, 1773 aa, Pseudoplusia includens
MEVDVRITTAALLIFAATLVSAQTNQLRCTYIQEIPRGDTPVFNFPSFDGVPWSQQPLLPLPQREELCMEDPVSAGSSVIMTIYMEEEIEEEIAIAKLNYKGTGTPEIGPAFTTGSFHTLGPVFRRIPEDGEWHLVITNKQDFEAPNMQRYWFDISVPGESVGLMVLLEIVNIDDNAPIVHMIDRCEIPEPGTHGRTACAYTVSDADGRISTEFMTYKIDSDRNDQDFFELVNDHTMDADEKITHMVLYLHKDLDFEVNPLHIFSVTAFDSKPNEHEVTMMVQVQNTDRRNPRWLDIFAVQQFNEKTTQRFPIRAIDGDTGIDRQIHYRLEADEEDTFFSLELAADGNGAVLVVDEIDRDTLMREVFQLSIVAYKYGPNDEEDRPSFETRANIVIIVIDVNDQRPIPFKQIDDDNNNDDGDDSSDDDEDSSADSSRNELAPEVPEDPTIRIYKITIEEETPMTLNLQDFGFHDRDLGENAQYEVHLESISPEGAEEAFSISPTRGYQDQSFIVSTRNHRLLDFEVEEFQKIRLRVIAIDLNDTSLRGEAWLHIDLENWNDEMPIFGQDVYTAEFDETVGEGFPVATVRATDRDIGDRVVHSLLGNAGDYLTIDPDTGEIFVAHDNYFDFHRQNEYFVQVRATDTLLDTNNTATAQLTIKLRNINNTPPTLLLPRFSPEVKENVPEDFVIPADIEATDPDLDAQLEFEIDWEQSYATKQGRPTPAIEFHNCLEIITVPTESRHRVVGRLDVREIRTGVTIDYEEFEILYLSIRVIDRNTVPGAIDYAESILAINIIDMNDNWPIWAAGQLQQSLRVREGSAAGVVIGSLLATDIDGPLYNKVRYSLVPIGETKPDLVTIDPIFGQLTVLTGGQIDADEPKTWALEYTVTASDRCVEDDGFPCTGDDPTVWNTEGYLCIDIIDTNNKSPETENANITVWVWENATEGDTVAQLSATDLDRDELYHTVRYQILYSVNLRLLNFFAVDLDTGLITVHYPTNEVLDRDGDEPEHTIFLNLFDNFYFDGDGQRNMAEKTVRVRLLDVNDNAPELPPPDELSWTVSEDEPAESRVLPEIYAPDRDEPDTDNSRVGYAILGLEVNRDIEVPELFTMVQIENVTGELETAMHLKGFWGTYTIHIQAYDHGIPQQVSEERYSLVVRPYNYHAPEFVFPQQGAVYRLSLEQSTVNGVLVQVSGQSFPRVTATDEDGLHAGAVTFSVVGAPGEYFSMRNFDDNTGELYLTQPLVNTELDITIRGTDGGTEPDSKFSELSFRLVFVTTLGDPTFAVEEHTVAFIEKEAGLLESFQLPTAVDAKNYLCEELNEPCHQIYYNFIEGNSQGYFQVEPTTNMISLTRELDRAVEARYVLRVGTSNAPIDPSAPPTLMAASTLLLTVNVREADPRPLFQRDIYSAGIYETDVTGKLLLTVHATHTEGLDITYSMDMETMEVDLSLEAVKDSALILHPTEGSLTLNFNPTANMVGMFEFDVVATDTAGATARTDVKIYLITHLNRVFFTFNNTLDVVDANREFIADTFSLGFSLPGFRLTCNIDAVLRATDSNGIARDDRTEVRAHFIRNNIPATTEEIEELRSNTLLINSIQETLFTRSLSLEDFVGGASPELEADNNLTVYVLSALTAMLGLLCLLLLVTFIIRTRALNRRLEALSMTKYGSVDSGLNRAGLAAPGTNKHAIEGSNPIWNETIKAPDFDAISDVSNDSDLIGIEDLPQFRSDYFPPGDDHSLQGIVLDNQNNDTVATHGNNFKFNASPFSPEFGNTPIRR

SEQ ID NO: 237 - protein, 1014 aa, Helicoverpa zea
MANRWYTLLLGAALLQSVLSFGPIEVTDDEWAEYRNLMRDPAYRLPTTTKPSNYAVNLTPYFTGTTLAFTFEGSVRITITATQANVNEIVLHCNDLTIESVMVATEASPNVNLIASGQTFVCDPVYSFLRIRTASALNINTNYIITSNFRGNLQTNMRGFYRSWYVDSSGTKRWMATTQFQPGHARQAFPCYDEPGFKATFDITINREADFSPTLSNMPIRTTTPLATGRVAETFHTTPETSTYLIAFIVSHYSQVASNNNQQRPFHIYARDNVGVHGNFALEIGVPLLEVMERYTEIPYYGMAQNMNMKQAAIPDFSAGAMENWGLLTYREALILFDPVNTNNFYRQRIANIISHEIAHMWFGNLVTCAWWDNLWLNEGFARFYQYYLTGVVAPEMGFETRFIVEQLHVSMLSDSLDSAHALTNPNVNDPTTVSAHFSTITYAKGASIIRMTQHLLGNNTFVKGLRTYLKDNAYGVAEPRHLFTALDAAATADNALANYGGMTIDRYFRSWSEKAGHPLLTVSIDHSSGRMTIIQTRFERNTGVSTATDSLWDIPITWTRAGSIDFDNLKPTQFISGVLTIIDRGTIGREWVIFNKQQTGFYRVNYDQITWGLITQALRSNVRLSIHEYNRAQIVDDVMLLARAGIMTYSRALNILSFLKFEDQYAPWGAAITGFNFALRRLAHDVTAHQKLRNEILDLSTAIVNRLGFSEPAVSNFMDDLLRMNVMTFLCDIGHQGCITAARTSFATWKNGGVVPPNMRPWVYCNGVRYGDQSDFTHLWNRYTASDVANDKLVMLSAAGCTLNQASLNIFLNAIVSGGDDIRPQDHSAAIAAAVRSNEVNTMRVFTWLQANVQQTINTLGSVSPILNEITARLLNEAQITQVQTWLNANQNLIGTAAHTSATNGIATSRSNIQWYTQRVPEFNVYFETGYVEENFADTTTTSTTTTTTTTTTTTAAPTTTTTTEAPTTTTTTTTGAPTTTTTEATTTPVPGSANIATLSIVTMIVTLVVNMA

SEQ ID NO: 238 - protein, 535 aa, Helicoverpa zea
MVTLFPYVVAVLCGATSVRAYWLHPAAPAAASRAETSANYWAQDAQAAINARLERVESVKKARNVIMFLGDGMSVPTLAAARTLLGQRQGKTGEETKLHFETFPTIGLVKTYCVDAQIADSACTATAYLCGVKNNYGAIGVDGTVRRGDCQAASNTATHVESIAEWALADGRDVGIVTTTRITHASPAGTFAKTANRTWENDGEVSQMGLDAKDCPDIAHQLVHHHPGNKFKVIFGGGKRAFLPNTEQDEKRSYGRRIDNRNLIKEWEDDKVSRNVSHQYVWHREQLMRLKEDLPEYMLGLFESSHMTYHLKSDPQSEPTLAELTEVAIRSLRRNEKGFFLFVEGGRIDHAHHDNLVELALDETLEMDKAVATATEMLSEDDSLIVVTADHAHVMTFNGYSNRGHNILGPSRDVGLDNVPYMTLTYANGPGFRPHVNNIRPDVTLEPNYRTLDWESHVDVPLVDETHGGDDVAVFARGPHHSMFTGLYEQSQLPHLMAYAACIGPGRHACASAAHLPSAHFFVALLALFTSILLR

SEQ ID NO: 239 - protein, 535 aa, Helicoverpa zea
MVTLFPYVVAVLCGATSARAHWLHPAAPAAASRAETSANYWAQDAQAAINARLERVESVKKARNVIMFLGDGMSVPTLAAARTLLGQRQGKTGEETKLHFETFPTIGLVKTYCVDAQIADSACTATAYLCGVKNNYGAIGVDGTVRRGDCQAASNTATHVESIAEWALADGRDVGIVTTTRITHASPAGTFAKTANRTWENDGEVSQMGLDAKDCPDIAHQLVHHHPGNKFKVIFGGGRRAFLPNTVQDDEGSYGRRIDNRDLIQEWKNDKDSRNVSHQYLWQREQLMNLNDDLPEYMLGLFESSHMEYHLKSDPQTEPTLAELTEVAIRSLRRNEKGFFLFVEGGRIDHAHHDNLVELALDETLEMDKAVATATKMLSEDDSLIVVTADHAHVMTINGYSGRGNDILGPSRDVGRDRMPYMTLSYTNGPGFRPHVNDIRQNVTAEPNYRTLDWESHVDVPLVDETHGGDDVAVFARGPHHSMFTGLYEQSQLPHLMAYAACIGPGRHACASAAHLPSAHFFVALLALFISILLR

SEQ ID NO: 240 - protein, 1013 aa, Helicoverpa zea
MAAIKLLVLSLACACVIAHSPIPPVSRTIFLDERLEGGAFENIDAFKNIELSNAAASPYRLPNTTFPTHYKVLWVINLSDNEQTYSGTVDITLQATQPNVNEIVIHCDHLTVTSVVLRQGTATEGTLIPTTPTPQSQYHFLRVALNDGVLLYNENVPVQYTLSIAFNAEMRDDMYGIYRSWYRNLPTDNNIRWMATTQFQATAARYALPCYDEPGYKAKFDVTIRRPLGYKSWFCTRQRITRPSTTGYAEDEYHTTPEMSTYLLALIVADYDSLATLDANDRVLHEVIARPGAIINGQAAYAQRAGQDLLGNMSDHTGFDFYKQDENLKMTQAAIPDFGAGAMENWGLLTYREAYILYDEQHTSSNFKQIIAYILSHEIAHMWFGNLVTNAWWDVLWLNEGFARYYQYFLTAWVEDMGLATRFINEQVHASLLSDSSIYAHPLTNPGVGSPAAVSAMFSTITYNKGASVIRMTEHLLGFEVHRAGLRKYLEDMKFKTVQPIDLFTALETAGNDAGALDAYGDHFDFVKYYESWTEQPGHPVLNVHINHQTGHMTIYQRRFDIDTGYSVQNRNYIVPITFTTGADPDFSNTKPSHVISKAVTVIDRGVVGDVWTIFNIQQTGFYRVNYDDYTWDLIILALRGADREKIHEYNRAQIVNDVFQFARSGLMTYERALNILSYLENETDYAPWVAAITGFNWLRNRLVGKPQLAELNAKIVQWSSKVMSELTYMPIEGEPFMRSYLRWQLAPVMCNLNVPACRAGARVIFDNLRLYQHEVPVDSRSWVYCNALRDGGAVEFDHLYNRFKAHNVYTEKILILQTLGCTSHPASLTTLLNDIVTPNNIIRPQDYTTAFSTAVSGNEENTLFVLNYIQNNLETVLKAFTSPRTPLSYIAARLRTVEDVTAYQTWLNLTTTREVLGTSYNNIYGDSVAAYNSILWVATVEDSLSAYLTNGDNVIQPTTSTTTTTVAPTTVTQPPITEPSTPSLPVPVTDGAMTSFASLFIISLGAILHLIL

SEQ ID NO: 241 - protein, 1359 aa, Spodoptera frugiperda
MDTKKGSKNDSKSKPPPPKPKSVPNVFKRTFFCWMLPIFYFGNRRDLEESDLPPPKNMYQSKMLGDKLERSWLKEEHEAKLAGRKPKFTKVLFKTFIWSYIPGGLMQATSIGLRTASPLLFSQLLRYWAADSPVDRETAMYYAISMILANWASSFMNHHGVLFCQQFGMKLRCAVGSLMFRKIMRMSNGSLGDTAAGKVVNILSNDLQRFDLSMVFLHYVWIIPLQIAAVIYLGYLQAGTAAFIGFAALIIIALPFQGGLGQYLGKIRLRTAEKTDNRIKIMSEVINGIQVIKMYAWEIPFQKVVGQKRAEELKEVKIATILRTVFLGFMMFTERAALFFTVLTYVLLGNVMSANVFYPLQQFMSAAQVNITLILPMVLSFTAELFVSLGRVEKFLLLEDRPDLKGHPEETSSNLFRNMSADGIPETNGSIRPLSYHRKSEASPIEPGSEIQLKVPKFTRSVSYQEDSALVLHDVSASWTGDPNMMALKNISMRLRKGKLCAIIGAVGSGKSSILQLLLKELPSATGTISIYGKMSYACQEAWLFPSTVRENILFGLPFEPGKYKKVCRVCALEKDFKQFPYGDQTLVGERGVSLSGGQRARINLARAVYREADIYLLDDPLSAVDANVGRQLFEGCINGYLRGRTRILVTHQIHFLKAADYIVVLNEGRIENMGTFDELVSSGKEFAMMLAQLQEGKEKDTESVGSRSIEEKEKPALKTMISVNEGEEVQEFEAQKMKEEERQSGNLRWEVISAYFRSGGHVCFILFALLVVVLATTCAASVDYWVSYWTNQMAAYEESLGGESIEPGLDVQAGRFTVGQYLTIHGCLVAALVLMVNLRVFPFAYLCVSASAKLHNQMFSTMLRGVMRFFDTSSSGRILNRFTKDMGSLDEILPRTLLDVLQIYGTLTAILVLNAIALYWTLVPSAVLLVLFGFMVRIYLKAAQGIKRLEGTTKSPMFGTVTSSLSGISTIRASNAQERLIEQFDINQDLHTTSWNSYLNGGTTFGFYLDTMCLVYMTTIIFVFLFIDFGDAIPVGSVGLAVTQSNTLTLMLQHGARMLVEFLAQLTSVERILEYTRIDTEPDLFQGKVEMPPNWPYQGRIEFQNVSLRYAPNEQPVLKNLNIVIESGNKIGIVGRTGAGKSSLISALFRFAYLDGLISIDGLDTSLISRQGLRSKISIIPQEPILFSATIRYNLDPFDIYSDDDLWRALEQVDLKSAVPSLDFKVTEGGSNFSVGQRQLMCLARAVLRSNQILIMDEATANVDPQTDNFIQETIRRQFVSCTVLTIAHRLNTIMDSDKVLVMSSGQVAEYDHPYVLLSDPNSHFSAMVRETGEKNSANLFQVAKDAYFQSNLKENAR

SEQ ID NO: 242 - protein, 541 aa, Spodoptera frugiperda
MRSLLTYLVAAVVVAACVRGDRYHPADPGSRADTVVNRAETSANYWAQEAQAAINARLAHKESVKKARNVVMFLGDGMSVPTLAAARTLLGQRRGHTGEEDKLHFETFPTVGLTKTYCVNAQIPDSACTATAYLCGVKTTYGAIGVNAEVPRKGCEASTDTSRHVESIAEWALADGRDAGIVTTTRITHASPAGVYAKVADRNWEHNQAVENDGFDTDKCPDIALQLVHKHPGNKLKVILGGGRLNFLPNDVKDEEGVYGNRTDTRNLIEEWAQDKEDRKVTHKYVWNREQLMSLKDDLPEYLLGLFESNHLQYNMQADPNTEPTLTELTEIAIKSLSRNEKGFFLFVEGGRIDHAHHRNWVELALDETLEMDKAVARAAELLSEDDSLIVVTADHSHVMAYNGYSARGHDILGPSRDLDLDGVPYMTLSYTNGPGFRSHMNGIRPDVTAEDGFGEDEWLAHVDVPLIDETHGGDDVAVFARGPHHSMFTGLYEQSQLPHLMAYAACIGPGRHACSGAAHALAQPVLLLSLLVLLTSLFQQ

SEQ ID NO: 243 - protein, 1021 aa, Spodoptera frugiperda
MASRWFNLLLGVILLQSVLAFGPIDVTDAEWIEYMGLINNPNYRLPTTTRPLHYKVRLQPNLDQDFELNGDVEINIKVESGNQPINEIKLHCQDMVINSLTVTSTTNTQVNLAQGTQFVCEETTSFLTIPTTTQLLNGNEYIIKISFVGKLQSGMRGFYRSWFFDENKQKRWMATTQFQPGHARQAFPCYDEPGFKATFDIILVRDDSLISLSNMPIRETITSTLYPQKKEDIYYTTPIMSTYLLAFIVADYKRIESGTNVNRPFHIYARGNVGDTGKYSLEVGEKLLTLMESYTQYNYYTMASHMEMKQAAIPDFSAGAMENWGLLTYREALILYDPENSNNFYKQRIANIISHEIAHMWFGNLVTCAWWDTLWLNEGFARYYQYYMTDKAEPHMGFKTRFIVEQLQMAMLSDSFSNAHALTNPAVSDPDSVSNHFSTITYAKGASILRMTEHLLGGDTYEKGLREYLKKREFNTAEPKDLFESLDAAANADNSLADYDDMTIAKYFASWSEKAGHPLLTVHVDHASGRMTVVQTQFDVNSGVSSDNGLWHIPLTWTRAGNPEFENLKPSEFMSGPLKIINRGSTGREWVIFNKQQSGFYRVNYDATTWALLTQALRSNEREAIHEYNRAQIVDDVFVLARSNILSYTRALNILSFLEFEDKYAPWVAAITGFNFALRRLAHKTEEQQKLKDIIFKSSAAIIQRLGYTEASNADPLFMDNLLRMHLMTFLCNAGHAQCSQTGREYFKAWRESGTRIPPNMRPWVYCEGLRTGDLADFDYFWNRYVDEDLSNEKVVMIGAAGCTGNTEALHKFLSVIVDPKPTEQSIELIRPQDYSAAISSAVTSNEYNTMKVLEWLKDNPSHLQNGNGVSLLRSAASRLLNEADIFKVETWFATITSDEAIQAIKDGIATSNNNIKWYNSRVGEFSDYFETGYFDDLTGGSETPDPTTPEPTTAEPTTPEPTTPEPTTAEPTTAEPTTDESTPAEPTTAEPTTDEPEPGSANIASLSFFTLLVTLIINMV

SEQ ID NO: 244 - protein, 765 aa, Diabrotica virgifera virgifera
MRTKLVIFLCLVLFVTSVYNEDIPVNSLLDELHPAAEFSRHTLVKPKLYHGREKRQISSTKEKSGKHTDHLQITMEVDGEDMILDLTINKDLIPEGFFHKHQKNGDYKIHQPTFQEANICEYNGKVRGKPNSWVALSTCDGLSGVVFDGEEMHYVEKGNSIGDVEADHFLYRYSDLLEHNKTCGYAGDAVDPEKAIHAHNNNRILRYKRDTDEQLVRGPYNANKESKYVELVLVIDNQEYKELGESKTKVVNHAKTIANIINGLYSPLNIFIALVGVVIWTENDEINFSPNGDTTLTNFLHYRREKLIKSHPNDNAQLLTKFNFDHGVVGKALKGPICTYEFSGGVNTDHSPVVGLVATTVAHEMGHNFGMEHDTNECECPDDRCIMAPSSSTVAPKHWSSCSLNYLLQAFTHGMDYCLKNKPKALFDSPVCGNGFVEPGEQCDCGLEEHCDNYCCNATTCMLHSNASCATGECCDLTTCLPKGAGTLCRSADYECDLPEYCTGQSEYCPEDNYKLDTEVCDDGKAFCYHGFCSTRSDQCKLLWGETGKSSDDQCYMMNTKGTRHGNCGYDKLTQTFFKCENESVLCGMLHCEHLNEKLEFGMESVAMLSHTFINKKGLIIPCRTAIVDLGINQVDPGLTPDGALCGKGKMCVNQKCMSVSSLKKQGPHCPDDCNGNGWCNNKGHCHCKDGFAPPTCDYPGPGGSLDSGPAADPNGQYLEKKICEITNKAAEKYLRSGINIKCLIPFCCPPKHPIRNLILKDLGD

SEQ ID NO: 245 - protein, 765 aa, Diabrotica virgifera virgifera
MRTKLVIFLCLVLFVTSVYNEDIPVNSLLDELHPAAEFSRHTLVKPKLYHGREKRQISSTKEKSGKHTDHLQITMEVDGENMILDLTINKDLIPEGFFHKHQENGDYKIHQPTFQEANICEYNGKVRGKANSWVALSTCDGLSGVIFDGEEMHYVEKGNSIGDVEADHFLYKYSDLLEHNKTCGYAGDAVDPEKAVHAHNNNRILRYKRDTDEQLVRGPYNANKESKYVELVLVIDNQEYKELGESKTKVVNHAKTIANIINGLYSPLNIFIALVGVVIWTENDEINFSPNGDTTLTNFLHYRREKLIKSHPNDNAQLLTKFNFDHGVVGKALKGPICTYEFSGGVNTDHSPVVGLVATTVAHEMGHNFGMEHDTNECECPDDRCIMAPSSSTVAPKHWSSCSLNYLLQAFTHGMDYCLKNKPKALFDSPVCGNGFVEPGEQCDCGLEEHCDNYCCNATTCMLHSNASCATGECCDLTTCLPKGAGTLCRSADYECDLPEYCTGQSEYCPEDNYKLDTEVCDDGKAFCYHGFCSTRSDQCKLLWGETGKSSDDQCYMMNTKGTRHGNCGYDKLTQTFFKCENESVLCGMLHCEHLNEKLEFGMESVAMLSHTFINKKGLIIPCRTAIVDLGINQVDPGLTPDGALCGKGKMCVNQKCMSVSSLKKQGPHCPDDCNGNGWCNNKGHCHCKDGFAPPTCDYPGPGGSLDSGPAADPNGQYLEKKICEITNKAAEKYLRSGINIKCLIPFCCPPKHPIRNLILKDLGD

SEQ ID NO: 246 - protein, 1421 aa, Diabrotica virgifera virgifera
MRTKLVIFLCLVLFVTSVYNEDIPVNSLLDELHPAAEFSRHTLVKPKLYHGREKRQISSTKEKSGKHTDHLQITMEVDGENMILDLTINKDLIPEGFFHKHQENGDYKIHQPTFQEANICEYNGKVRGKANSWVALSTCDGLSGVIFDGEEMHYVEKGNSIGDVEADHFLYKYSDLLEHNKTCGYAGDAVDPEKAVHAHNNNRILRYKRDTDEQLVRGPYNANKESKYVELVLVIDNQEYKELGESKTKVVNHAKTIANIINGLYSPLNIFIALVGVVIWTENDEINFSPNGDTTLTNFLHYRREKLIKSHPNDNAQLLTKFNFDHGVVGKALKGPICTYEFSGGVNTDHSPVVGLVATTVAHEMGHNFGMEHDTNECECPDDRCIMAPSSSTVAPKHWSSCSLNYLLQAFTHGMDYCLKNKPKALFDSPVCGNGFVEPGEQCDCGLEEHCDNYCCNATTCMLHSNASCATGECCDLTTCLPKGAGTLCRSADYECDLPEYCTGQSEYCPEDNYKLDTEVCDDGKAFCYHGFCSTRSDQCKLLWGETGKSSDDQCYMMNTKGTRHGNCGYDKLTQTFFKCENESVLCGMLHCEHLNEKLEFGMESVAMLSHTFINKKGLIIPCRTAIVDLGINQVDPGLTPDGALCGKGKMCVNQKCMSVSSLKKQGPHCPDDCNGNGWCNNKGHCHCKDGFAPPTCDYPGPGGSLDSGPAADPNARQGIVAALFIIFLGIVPLVAISAFLLYYVRHNLHFGRRKSTPSTTKSPSKSRGPPFASEVTKRTEDNHSLLREDSPPPIGFIGLSNNFFGNFKGFSIIPLKNETQPSRSAPPPPVIVPAKSKSSASSTSKPAKPAATQETKHSIFSNPIQKYNSFRKSNVPNGIVTVNQVSAAPALPPPNPGSHAKPIISSPILENSTCTAKELVSPLRNAPKLPIRAAPQAPSIEITRTLNRITSFLKPADKKPTIVSKPSQVKATKVLDKESLRNIEISNPIPQKNIEISVSTLPVDSATTKNVVMRAQSMRATKQTDRPNIQTFGSMRQPNGYKRPLSIPSGSRPKNPPPPRPPLEKSQEKSASDQSDQYDDCLNEEVPLATGTTTSPSGDNIYAVIEDSPVVSPENKPSNSGSSESMGLLGEIVNEIQSRNFDSIYSTSTLARKKKEEEEKKKAQLSPDSSETYVNTASLQYPESEYSNMSGNIKSSASSTSSGYILPSAINIPVKEETKPKEEPKPSLSSFKADSKPAVVNKPLASGFKPSQANLKKVETSPERKSKVLSSPTSKTPPKSVSRQITPPNLRTRKPSPTRPTAPVHKSNRSVTNSPDLVTSCNTNSSSKPPDIVGTNSVTKKPSITSAKPTVPLPKVKSNPKAVNAKVSQEKKGDAKPVVANKLNKTSTSDSTTKTSVGVRNAARSNSNVASLQQKFENKT

SEQ ID NO: 247 - protein, 1306 aa, Diabrotica virgifera virgifera
MDTGNKTTKPRNPAENTNPISFLFFFYMFPIFKKTYKYKLTEEELFSPLKEHTSSRLGSKLEKAWKEEYRIHKKTALHRALFRIFGLRYTVLGLIRLFDELLLIVVMPYCIRTLVAYLEAGQTKITKDEALIYAAALVITLLLDAVMQQPNYMGLQHIAMKIRVACSSLIYRKTLRFSREALGNTTVGQLVNLLSNDVSKFDQLFGLTHYAWIGPIQVALGTWLLYREIGVSAFFGMAILVAFVPLQIWLAKKMSVMRLKTALRTDERVKLMNEIISGIQVIKMYCWEKPFAHVIDLARRSEMRAIRSHSCLLGILYSFEVFVSRTAIFVSIVGYVLLGNYVSADKVFAITAIYNQMRTIITIIFSLSITALAEMHVTIDRIHKLMIFDEREQDSEDGYEKMNGNYQSKLNGLDGMKNGINGNGTAIELIKKVKEPKLMLSGVSAKWLAQSPENNLSDITFNVPPNKMLAIIGPVGSGKSSIINLILKELPVKSGKLEIDGKVSYASQEPWLFAASVRQNILFGEEYDEERYKLVVEVCALKSDFALFPHGDKTLVGEKGKALSGGQKARVNLARCVYKKADIYLLDDPLSAVDANVGKHLYDRCIKQFLSNKICVLVTHQLQYLRNADKIIIMKDGKMEMTGSYTELKKSGLDFAKVMEEFNEEAEEDKRMKSIKSKASIYDEPMEDEEDQVLEKEMQEKGTIKAATYYLYLKAGGGICSMLALGFLFIICQVVANAGEYYVTYWVNLEQDFSEKQRMNLTAPNETINRDLIMWSYTALIVGNIIISVVKAVYFMIFFVIASKNLHKYIFDKLIKATMRFYNTNPSGRILNRFSKDLGTVDEYLPSVIIDVIEIALLLLGAITLSAIVEPLLTVPAVVLMIIFYLLKIVYSETSRSVKRVEAITKSPMLSHLTASVNGLSTVRAFHAEKMLTEEFDNYQDSHSAAWFLYLASSKCFGLWLDIICIVFIAVAVFSLLLFRDTIHGGDLGLVITQYLGLMGSLQWGMRQWTELENNMTSVERILEYTRLETEPERKEPKNIPQPWPEKGLVEFRDVSLRYSPQDPPVLKGLNFTVQPKEKIGIVGRTGAGKSSTITALFQLYPLEGTVVVDGVDTTQIPLDLVRTNISIIPQEPVLFSGKMRENLDPFENYSDDVLWNALDQVELKDVISELPAGLNTEVTEGGNNFSVGQRQLVCLARALIRNNKILVMDEATANVDPHTDSLIQKTIRDKFADCTVLTIAHRLHTVMDSDKILVMNSGRVEEFNHPYLLLQNVHGVLHNLVDATGPSTAKNLENIAKESYEKKRV

SEQ ID NO: 248 - protein, 934 aa, Diabrotica virgifera virgifera
MWVILLLSILASATASNPDLASSDTDPDLFPVQRATEEAEISSNKYLLSSPVIPTHYDVGLTVPLEALSGGSTNYDGTVDITLSVINATNVVQLHSLVNIVSITFTDSSIVIHNYTLNPNLETISIFLNSTLNANAIYKLNIKFNASLEKVNMRGFYRSDYIINGTKEYLATTQFQATSARRAFPCFDEPGLKATFQLTLTHPSEFNAKSNTPSQSQAVVQATNTTTTVFEKTPVMSIYLIAIVISKFNCTSSTNLGTNFGVCSRTDLSNDRNEALKYGMKILEAFDTYTASPYNLTNLKKLDQFAIPDFSAGAMENWGIVTYREYSLIWNNEQTSRALRQSLLSIVAHEFAHNWFGNLVTTKWWDTTFLNEGFARYFQYFILTKITDLSDFQMDKQFIVEQQQTAFIEDASPLSRSLTSEAWTPAEISNKFNTISYNKGACVFRMIENLIGSVAFQTALQKYLNATAYGSGTTEKLWANFPNSIALPPNVNFTDFVDNWTNKPGFPVVNAVFNGKNVTFSQKRFLYTGNNNTQWYIPVTYRLSNSSSYETFWLAPNSSVTILNNLTDKDWLIVNDDSRGYYRVKYCKRLTQRIQSLLNQNHTQISELNRAQILDDSLNLARAGYIKYSEAFELLEYLKNETSYFPWFTTIKNMDYLVTRLGANTELGKRTNAMILDLISQISANISTTKWEEIDQVTTLKLQRVWADACKRGQASCISETKRLFQALRLNKTSVNPNIRDVVYCNALRNSNNIAADWEFLWNRLLISIHPQEDLYILLSLGCTTHKPYLTRLLDATINSTSVIKLQNLYTVWNSVGSASKEGLDLAFEYFVNNYKKIIEYYPDGISLLSQLANRFTTNAEVTKLQQFADRLEKNSTIRAVANSALTTARQNLQFRARIEDDLNDYFKIDNSGSSVTPLGIFMPLLLLSVVFFM

SEQ ID NO: 249 - protein, 261 aa, Diabrotica virgifera virgifera
YDEQVFFSVMTGSMNFGIASPYIEAFGISKAAASKIFSVIDHKPTINLSKGNGKTLNVLIGNIQFKDVAFRYPSRKDVPILKGLSLNIKSGDTVALVGSSGCGKSTVIQLLQRLYDADSGEVTIDGKNIKEYDLTWLRSQIGVVGQEPILFGTSILENIRYGKDGVTEEDVIQAAKKANAHNFIKALPNGYNTLVGEKGAQLSGGQKQRIAIARALVRNPTLLLLDEATSALDNTSEAKVQAALDAASVECTTIIVAHRLS

SEQ ID NO: 250 - protein, 261 aa, Diabrotica virgifera virgifera; identical to SEQ ID NO: 249

SEQ ID NO: 251 - protein, 1323 aa, Diabrotica virgifera virgifera
  misc_feature (896)..(896): Xaa can be any naturally occurring amino acid
  misc_feature (1291)..(1291): Xaa can be any naturally occurring amino acid
MEMTKEKYNPNPRETANIISALFFGYTYDVFKKGLSKTLEVDDLYNPLKSDRSKVLGDNLQRNWDKQLEKSKKSNSKPSLLKAIVMSFWLEYAKLGIYTITTDLVLRLIQPLILGNLLDYFKPESQVSENEALTYAGILVAINILNILMSNQYMLEVFHSGMRIRASCCAVIYRKSLKLSKTALGETASGKLVNLLSNDVSRFDIVSLFIHQLWMAPVLSLIVMGILYQRTGYAGVVGVVAVFVIVPFQTYTGKLSAIYRKQTAFKTDERVRLMDEIISGIQVIKMYAWEIPFRKIIRIARRNEIKIITKSAYVRATFMALNLFTTRLALFCTLLTVILSNEEITASKVFVVMGYFNVLSMAMSTMFSRGVSEMAEVMVAIRRIRDFLINEEYDPNRTNFAMNGNVNSVDDFKEIISLQNLTVKWNASFSDNALENININISDGQMVGIIGPVGSGKSSLLQTLLGELDITEGSMRVRGQISYASQEPWVFASTVRQNILFGEEYDKKRYHEVIEACSLEKDFEQFPNGDLTLVGDRGSSLSGGQKARINLARAVYREADVYLLDDPLSAVDIHVSKHLYEKCINGYLANRTRILVTHQVHYLKDADNIIILNNGRIEDEGTFNFLANSDNVYAKLLTAEPENVEEKKQDRSKYNRQLSIRSRKDSLASIVSELSIADTLISNDIDFEEEEAEKQLEFDVKDLQEQSSKGKVGGSLLFKYMLAGSNSFAVLICVILYLGTQLAASGVDYWVSYWVNVEEFRSSSESSNSTTPTFIIPSIELTTNNCLYIYGFLLGALFVLAMTRSFFFYKLAMWSSKKLHATIFDNIVTATMRFFDTNPGGRILNRFSKDMGCVDELLPKAILDSSQMLLSMCGSLLLIVVVNPYFLILIGALSVXFGFMRHVYLKSSKNIKRLEGIMRSPVFTHLRATIEGLTTIRAFGAQSTLMDEFDHHQDYHSGAWYMFIVSSNAFGFYLDCFCSLFLAALTFSLLLFGEAFNLKGGQVGLAITQATALTSLLQWGMRQSAEVTNQLMSVERVLEYQNLEKEPQPVVPQKPAKEWPQKGEITFKDTCLKYFEGGPLVLKHLDLKIQPKEKVGVVGRTGAGKSSLIQALFRLAPIEGSIKIDDIDTKDISLNDLRLKISIIPQDPVLFSGTLRYNLDPFEEYSDEVLYKAIQDVELKDPANVINRLENRVMDRGSNYSVGQRQLICLARAILKNNKVLMLDEATANVDPQTDALIQKTIRRKFSDCTVITVAHRLNTIMDSDKVLVMDAGQISEFDHPHLLLQNKTEXFYSMVAETGRTTAEQLRKIASDSYQKLNALPE

SEQ ID NO: 252 - protein, 1323 aa, Diabrotica virgifera virgifera
MEMTKEKYNPNPRETANILSALFFGYTYDVFKKGLSKTLEVDDLYNPLKSDRSKVLGDNLQRNWDKQLEKSKKSNSKPSLLKAIVMSFWLEYAKLGIYTITTDLVLRLIQPLILGNLLDYFKPEAQVSKNEALTYAGILVAINILNILMSNQYMLEVFHSGMRIRASCCAVIYRKSLKLSKTALGETASGKLVNLLSNDVSRFDIVSLFIHQLWMAPVLSLIVMGILYQRTGYAGVVGVVAVFVIVPFQTYTGKLSAIYRKQTAFKTDERVRLMDEIISGIQVIKMYAWEIPFRKIIRIARRNEIKIITKSAYVRATFMALNLFTTRLALFCTLLTVILSNEEITASKVFVVMGYFNVLSMAMSTMFSRGVSEMAEVMVAIRRIRDFLINEEYDPNRTNFAMNGNVNSVDDFKEIISLQNLTVKWNASFSDNALENININISDGQMVGIIGPVGSGKSSLLQTLLGELDITEGSMRVRGQISYASQEPWVFASTVRQNILFGEEYDKKRYHEVIEACSLEKDFEQFPNGDLTLVGDRGSSLSGGQKARINLARAVYREADVYLLDDPLSAVDIHVSKHLYEKCINGYLANRTRILVTHQVHYLKDADNIIILNNGRIEDEGTFNFLANSDNVYAKLLTAEPENVEEKKQDRSKYNRQLSIRSRKDSLASIVSELSIADTLISNDIDFEEEEAEKQLEFDVKDLQEQSSKGKVGGSLLFKYMLAGSNSFAVLICVILYLGTQLAASGVDYWVSYWVNVEEFRSSSESSNSTTPTFIIPSIELTTNNCLYIYGFLLGALFVLAMTRSFFFYKLAMWSSKKLHATIFDNIVTATMRFFDTNPGGRILNRFSKDMGCVDELLPKAILDSSQMLLSMCGSLLLIVVVNPYFLILIGALSVVFGFMRHVYLKSSKNIKRLEGIMRSPVFTHLRATIEGLTTIRAFGAQSTLMDEFDHHQDYHSGAWYMFIVSSNAFGFYLDCFCSLFLAALTFSLLLFGEAFNLKGGQVGLAITQATALTSLLQWGMRQSAEVTNQLMSVERVLEYQNLEKEPQPVVPQKPAKEWPQKGEITFKDTCLKYFEGGPLVLKHLDLKIQPKEKVGVVGRTGAGKSSLIQALFRLAPIEGSIKIDDIDTKDISLNDLRLKISIIPQDPVLFSGTLRYNLDPFEEYSDEVLYKAIQDVELKDPANVINRLENRVMDRGSNYSVGQRQLICLARAILKNNKVLMLDEATANVDPQTDALIQKTIRRKFSDCTVITVAHRLNTIMDSDKVLVMDAGQISEFDHPHLLLQNKNGVFYSMVAETGRTTAEQLRKIASDSYQKLNALPE

SEQ ID NO: 253 - protein, 1323 aa, Diabrotica virgifera virgifera
  misc_feature (896)..(896): Xaa can be any naturally occurring amino acid
  misc_feature (1308)..(1308): Xaa can be any naturally occurring amino acid
MEMTKEKYNPNPRETANIISALFFGYTYDVFKKGLSKTLEVDDLYNPLKSDRSKVLGDNLQRNWDKQLEKSKKSNSKPSLLKAIVMSFWLEYAKLGIYTITTDLVLRLIQPLILGNLLDYFKPESQVSENEALTYAGILVAINILNILMSNQYMLEVFHSGMRIRASCCAVIYRKSLKLSKTALGETASGKLVNLLSNDVSRFDIVSLFIHQLWMAPVLSLIVMGILYQRTGYAGVVGVVAVFVIVPFQTYTGKLSAIYRKQTAFKTDERVRLMDEIISGIQVIKMYAWEIPFRKIIRIARRNEIKIITKSAYVRATFMALNLFTTRLALFCTLLTVILSNEEITASKVFVVMGYFNVLSMAMSTMFSRGVSEMAEVMVAIRRIRDFLINEEYDPNRTNFAMNGNVNSVDDFKEIISLQNLTVKWNASFSDNALENININISDGQMVGIIGPVGSGKSSLLQTLLGELDITEGSMRVRGQISYASQEPWVFASTVRQNILFGEEYDKKRYHEVIEACSLEKDFEQFPNGDLTLVGDRGSSLSGGQKARINLARAVYREADVYLLDDPLSAVDIHVSKHLYEKCINGYLANRTRILVTHQVHYLKDADNIIILNNGRIEDEGTFNFLANSDNVYAKLLTAEPENVEEKKQDRSKYNRQLSIRSRKDSLASIVSELSIADTLISNDIDFEEEEAEKQLEFDVKDLQEQSSKGKVGGSLLFKYMLAGSNSFAVLICVILYLGTQLAASGVDYWVSYWVNVEEFRSSSESSNSTTPTFIIPSIELTTNNCLYIYGFLLGALFVLAMTRSFFFYKLAMWSSKKLHATIFDNIVTATMRFFDTNPGGRILNRFSKDMGCVDELLPKAILDSSQMLLSMCGSLLLIVVVNPYFLILIGALSVXFGFMRHVYLKSSKNIKRLEGIMRSPVFTHLRATIEGLTTIRAFGAQSTLMDEFDHHQDYHSGAWYMFIVSSNAFGFYLDCFCSLFLAALTFSLLLFGEAFNLKGGQVGLAITQATALTSLLQWGMRQSAEVTNQLMSVERVLEYQNLEKEPQPVVPQKPAKEWPQKGEITFKDTCLKYFEGGPLVLKHLDLKIQPKEKVGVVGRTGAGKSSLIQALFRLAPIEGSIKIDDIDTKDISLNDLRLKISIIPQDPVLFSGTLRYNLDPFEEYSDEVLYKAIQDVELKDPANVINRLENRVMDRGSNYSVGQRQLICLARAILKNNKVLMLDEATANVDPQTDALIQKTIRRKFSDCTVITVAHRLNTIMDSDKVLVMDAGQISEFDHPHLLLQNKTEFFKSMVCETGRATAEQLXKIASDSYQKLQALPE

SEQ ID NO: 254 - protein, 1323 aa, Diabrotica virgifera virgifera; identical to SEQ ID NO: 253
  misc_feature (896)..(896): Xaa can be any naturally occurring amino acid
  misc_feature (1308)..(1308): Xaa can be any naturally occurring amino acid

SEQ ID NO: 255 - protein, 934 aa, Diabrotica virgifera virgifera; identical to SEQ ID NO: 248

SEQ ID NO: 256 - protein, 935 aa, Diabrotica virgifera virgifera
MWVILLLSILASATTASNPDLASSDTDPDLFPIQRAAEEVEISSNKYLLSSPVIPTHYDVGLTVPLEALSGGSTNYDGTVDITLSVINATNVVQLHSLVNIVSITFTDSSIVIHNYTLNPNLETISIFLNSTLNANAIYKLNIKFNASLEKVNMRGFYRSDYIINGTKEYLATTQFQATSARRAFPCFDEPGLKATFQLTLTHPSEFNAKSNTPSQSQAVVQATNTTTTVFEKTPVMSIYLIAIVISKFNCTSSTNLGTNFGVCSRTDLSNDRNEALKYGMKILEAFDTYTASPYNLTNLKKLDQFAIPDFSAGAMENWGIVTYREYSLIWNNEQTSRALRQSLLSIVAHEFAHNWFGNLVTTKWWDTTFLNEGFARYFQYFILTKITDLSDFQMDKQFIVEQQQTAFIEDASPLSRSLTSEAWTPAEISNKFNTISYNKGACVFRMIENLIGSVAFQTALQKYLNATAYGSGTTEKLWANFPNSIALPPNVNFTDFVDNWTNKPGFPVVNAVFNGKNVTFSQKRFLYTGNNNTQWYIPVTYRLSNSSSYETFWLAPNSSVTILNNLTDKDWLIVNDDSRGYYRVKYCKRLTQRIQSLLNQNHTQISELNRAQILDDSLNLARAGYIKYSEAFELLEYLKNETSYFPWFTTIKNMDYLVTRLGANTELGKRTNAMILDLISQISANISTTKWEEIDQVTTLKLQRVWADACKRGQASCISETKRLFQALRLNKTSVNPNIRDVVYCNALRNSNNIAADWEFLWNRLLISIHPQEDLYILLSLGCTTHKPYLTRLLDATINSTSVIKLQNLYTVWNSVGSASKEGLDLAFEYFVNNYKKIIEYYPDGISLLSQLANRFTTNAEVTKLQQFADRLEKNSTIRAVANSALTTARQNLQFRARIEDDLNDYFKIDNSGSSVTPLGIFMPLLLLSVVFFM

SEQ ID NO: 257 - protein, 998 aa, Diabrotica virgifera virgifera
  misc_feature (199)..(199): Xaa can be any naturally occurring amino acid
MVGKVDYSSVPTSADLENNSNQKKYTVNQNGKQGVVIPRSLCALMAIGALLLAILVGLIVFFLVPRDCHATKSPQALTHQPPQSASVLNINSRGSSSNNDDTKAETTIAPIVTKVEVEQRLPRSIEPTHYRLRILPHFQNSTSEGSVTMTLNVLEDTNEIIFNSRSILIDEHSVSIRSTKPDSSLLEIKEQLYYEKEKXKIVLKEHLRKNEEYQLDLNFNGKLSGHLQGFYRIKYYDEYHRQRLIASTQFSPVDARSAFPCFDEPSFKANFQITIGRPADMLSLSNMPLAQKTPFSTNNSELWSWDEYPETPKMSTYLVAFMVMDFIKGAGDDPRMMFWARPQIAGNSAYAAQIGPKILSFYENYFGIKFPLSKIDIVAVPEFGFSAMENWGLITFREDVLLYDQQSSTNEDKRTTATILAHELAHQWFGNLVTPVFWNDLWLKEGFSNFLVYSGVNYAEPKWMFAEEFMLSENLDAMSEDALQTSRPISFDNIQNTVQIRQLFDPITYRKGAAIVNMISNFLGEKTFKTGLTNFLTKYSYKNADRNDLFASLTEEAHNRQILLPNETVKIIMDTWTERAGYPVIYAYADYEQNTLRLSQKRFLYRMRDEKSSYWVPLSFTTNVKPNYTDTFPKFWLKGEYETVQNVNLSDIKWYLLNLNQTGYFIVNYDERNWMSLVEAIMEVPTSIRAQLISDSMDLARANIISYDIPLRMIAKMAIRDNNIMFVPTAIAFEKLKYLSDILSSTPAFGFFESFHQTIFKESYKKVALEDPFDDYRTRRIRTTVLNWSCRSSETRCAHLSKIQFRQWMVGAKRVEPNLQQIVYCTALREGGQIEWDFAYKKYIEITSPTEKSTLLDALGCTRHTWLLSRYVDKILNDPSIRIQDADRVFQSVANNKFGTQIAFDFLRTNWVALLKHHGDGFNVIAKMVKALGPQMNTEFQLSELIRFRDSIHSNSSSASEAIASTIETVRGNVEWMQKNYHQVEQWLRKNKNNFDTL

SEQ ID NO: 258 - protein, 374 aa, Diabrotica virgifera virgifera
MILILFAFSAILFNGVHSVCLKNSITTASGLHAPKNKSLCSGQLIFEDNFNWLDTSKWDHEQTLTGGGNNEFQWYTDNRRNSYTYNGQLHIKPTFVADEYGEDFLYSGTIDIGAACTGGDNEGCRRTGSPNAIVNPIVSARMRTLHSFSFKYGRVEVNAKIPSGDWLWPAVWMLPTNWEYGNWPASGEIDIMESRGNRQYYAPNGQNVGTATESSTLHWGPTPQFNKQLKTHWEKINYNGGWDNAFHRYQVEWTPEHIKFSCDDQELGTITPPSGGFWEYGDLGPSGLPNPWSGGTRMAPFDKEFHLIINLAIGGAYFNDEFDNKAYKKPWTSTEPYRQGMTKFWQANQKWKPTWNLNSDDSHLKVDYVRVWAL

SEQ ID NO: 259 - protein, 1688 aa, Diabrotica virgifera virgifera
MATRNLCLCMLIWMPLFEGIVGDVAFGIAQIPGGKATVEDLKKGKYLLNMEENNHGGVIPTPLFTITGVDNTDCPNLNVEFTQGMKFKFSINESCIFYAEQTFDYESNERSYNFRISKSVNDEIDIAFSIKNIDDEPPQLGTFKCNFNEQLDYSLDDTPCNTTLHDPDGWLAQEKILIFIDTKDEDIFAIDLRKPLPNDTETDTYVFMYLLKQLNYEDTNFYQFTVQANDSGGNLSPQESAVVNVINIRSRPPKWSKITLFDQFDELTEQDYDIQALDGDTGIHADICYAKLGEDLPDNYINVSTDKTNKKGHIHVNPIDRDKDDLTLYHFNISAYVCDAPDYFTVNTVQYYIIDIDNNPPRIVENVGDDGKNTTFDDDNDHKNVTLSYLENYSRSYNFSTTITDRDTGENAQFTVSLENVEGSTVDYTQPYLIVPDNAYKTGSFIISVKNKTFLDFENDTWKKHSYYVVSNGKKDKSKTDRMLISVSLEDYNDELPIFEKESYTTEINETVANGTQILYTHATDRDAEDFELKMNIVGTYAENRLSIDKDGNIKVKVVNAFDYDVLNSVYFQVTATDKVNHVTRVPVTINILDVNNKAPVINQVDHIQIEENQQNGVVLNVTITATDVDTTANLTATINWEDSKVTKTNGAVVKTDAVIKAMQFLEIENTQTDDGLEMKLKVINNNDDNPDKPDFETFDTLYLSIVVEDRNTDPDFEQNRYTEGQIVINILDVNDNPPYFPPSNDDTRQVQEMSLKGVSVGSIKAVDVDLNSEITYHCTPEYEKFDWVDVNLTTGAITVKNDKQVDADTDKTYYFNYTCWAHDGVFFSKPLDISIYVIDTNNEVPVIDFPNEVHVKEKSLIDTVIKKIVTSDLDRDEPFRTVNCNFASDTDPDCQIEFYIDTNVLKVKRNKTLDRDKGRKTYPCLFECLDNPLNVRSQGQNKANKSFTIILDDINDHAPVLMTKDLQCSENLNKDGEVGEGIIGEDIDDGDNAKIDFSVLSIVDKETKNDIQESFNISKIDSDYVLNDTLKKVHLIAFEDLKGKYGTYEVTLHMHDEGDPMQTTDPDPTLTLTIEKWNYQTPSIIFPENDQTYIVLSDQQPGQPLALFNNTGTSNTLPDFSATDGETKDCSKWDVKFSYTQTNYEDDKIFVIDHIQPCVSQLQVSKHFNSDLVRSKKYKLTITASVKDGAEQEGEAGYSTSANISIVFLNNDAQPIFQNSDWSVSFVEFNTTQPAKPLEEQAEYENTKGGLPIYYHFYSENQTLSKYFEVDETSGDLSVIGNLTYDYDQDISFHIVASNDSQVRMLDPRSSLNVTVNFLPRNRRAPQWKSTKFFGAVMPTFVTGNLIVTAQAHDDDYIDQQRGLTCSISSEINRIGEGLDKIIGEPFYLSTENDAAKIFLDFTVQTTMTGRFEFKIKVEDNRDDYGNGPFESEADTTIFIITKDNTVDFQFYNDIEDVQDRETPMLKIISDIVGYDAYRQNIDTVTNSGLVRTRARLYFIDSKSSRRLQRTKSPADSGFELVNSETILNIVTNVNTFQNLASTLRSEQKLNLDSFETNSKSGNSEAALRAWLIGVSVVLGILVLLLLITLILKTRQLSNRIKKLTTPQFGSQESGLNRMGINAPTTNKHAIEGTNPVYNNNEIKKPKNMNDFDTHSIRSGDSDLVGIENNPEFDYNFNTNEDKTTYL

SEQ ID NO: 260 - protein, 1257 aa, Diabrotica virgifera virgifera
MGTKKDDIKEKKTNALDAKFVKKKENETKIKPISFFGMFKYASKGDKLLMFIGTLSAVITGCLPPINTILFGELAGNAVQYAETLYNATLSQNEQAEAQEKFFDGIKFFALANSMVGVAMLCFSYLSTITFNYSSTKQIFQIRSDYLKSILNQDISWYDQNQTGDFASRMSDDLSKFEDGIGEKVPMFIHFQVLFVAAVGTALAKGWELALISLVAIPASLVSFGVINLLTTKLAKNEMEAYAASGSIAEEVFSLIRTVTAFGGQQKEIDRYKEHLVSARKNNIKRTMIVGIGFGLVYLLLYSSYALSLWYGVKLVLKDRFNPNASYTPANMVTIFFAVLSASLNFGAASTYLEMFAISKAAAAKIFNVIESKPDINLSKSNGAKLDHLKGNIQFKNVKFHYPSRPDIPVLQGLDIEINPGETVALVGSSGCGKSTVVQLIQRFYNAVSGEILVDGTNIQNLDLTWYRNNIGVVGQEPVLFGTTILENIRYGKEEATEEEIIEAAKKANAHAFIKLLPKGYNTLVGERGTQLSGGQKQRIAIARALVRKPTLLLLDEATSALDNASEAKVQEALDLASAECTTIIVAHRLSTIRGANKIIVLLEGTVVEQGTHDELISLTGEYFKLVTAQVASSNQIELSNDETETKGNNEAYEEYNDDYDDISHDEKNEIDDFKNGKKITLFSIMKLNAPEWPYILIAGVGSIVVGWGWPIFAVFFGSVLGTLAKYDTEYIETETTRYCIFFVIAGVICMISVFLQNYLLGIAGEKMTERIRTQMFTAIISQEMGFFDKKSNGVGALCAKLAGDSSSIQGATGQRVGAILQSLSTFGIAIALSMYYQWKLGLLMASFTPLMLVAIFIEKRNTTGLSEAREKSLQKSTKIAVEAVGNIRTVAGLVAEDKFQKSYITELKPHYKAALAAVHWRGLVFGLSRSLGYFAYAAAMYYGGFLIRDGLYYDKVFKVAQAQLMGTISIANSLAFTPNLNRGISAAKRIKSFLSRIPLIRDGPSSKPMNQVDGNIGYSNVEFFYPTRKNIQVLRGLTINIPKGSTVALVGESGCGKSTIIQLIERFYDPSSGDINLDEQNIKHITLSSLRSHLGIVPQEPNLFNKSIAENIAYGDNSRNVPIDEIIQAAKNANIHNFIVGLPNGYDTELGEKATQLSGGQKQRIAIARALVQNPKILLLDEATSALDTESEKVVQAALDEAKKGRTCITIAHRLTTIQDADIIYVIDKGIVVESGTHRELLNKNGFYYKLYTQKH

SEQ ID NO: 261 - protein, 1290 aa, Diabrotica virgifera virgifera
MDTGNKTTKPRNPAENTNPISFLFFFYMFPIFKKTYKYKLTEEELFSPLKEHTSSRLGSKLEKAWKEEYRIHKKTALHRALFRIFGLRYTVLGLIRLFDELLLIVVMPYCIRTLVAYLEAGQTKITKDEALIYAAALVITLLLDAVMQQPNYMGLQHIAMKIRVACSSLIYRKTLRFSREALGNTTVGQLVNLLSNDVSKFDQLFGLTHYAWIGPIQVALGTWLLYREIGVSAFFGMAFLVAFVPLQIWLAKKMSVMRLKTALRTDERVKLMNEIISGIQVIKMYCWEKPFAHVIDLARRSEMRAIRSHSCLLGILYSFEVFVSRTAIFVSIVGYVLLGNYVSADKVFAITAIYNQMRTIITIIFSLSITALAEMHVTIDRIHKLMIFDEREQDSEDGYEKMNGNYQSKLNGLDGMKNGINGNGTAIELIKKVKEPKLMLSGVSAKWLAQSPENNLSDITFNVPPNKMLAIIGPVGSGKSSIINLILKELPVKSGKLEIDGKVSYASQEPWLFAASVRQNILFGEEYDEERYKLVVEVCALKSDFALFPHGDKTLVGEKGKALSGGQKARVNLARCVYKKADIYLLDDPLSAVDANVGKHLYDRCIKQFLSNKICVLVTHQLQYLRNADKIIIMKDGKMEMTGSYTELKKSGLDFAKVMEEFNEEAEEDKRMKSIKSKASIYDEPMEDEEDQVLEKEMQEKGTIKAATYYLYLKAGGGICSMLALGFLFIICQVVANAGEYYVTYWVNLEQDFSEKQRMNLTAPNETINRDLIMWSYTALIVGNIIISVVKAVYFMIFFVIASKNLHKYIFDKLIKATMRFYNTNPSGRILNRFSKDLGTVDEYLPSVIIDVIEIALLLLGAITLSAIVEPLLTVPAVVLMIIFYLLKIVYSETSRSVKRVEAITKSPMLSHLTASVNGLSTVRAFHAEKMLTEEFDNYQDSHSAAWFLYLASSKCFGLWLDIICIVFIAVAVFSLLLFRDTIHGGDLGLVITQYLGLMGSLQWGMRQWTELENNMTSVERILEYTRLETEPERKEPKNIPQPWPEKGLVEFRDVSLRYSPQDPPVLKGLNFTVQPKEKIGIVGRTGAGKSSTITALFQLYPLEGTVVVDGVDTTQIPLDLVRTNISIIPQEPVLFSGKMRENLDPFENYSDDVLWNALDQVELKDVISELPAGLNTEVTEGGNNFSVGQRQLVCLARALIRNNKILVMDEATANVDPHTDSLIQKTIRDKFADCTVLTIAHRLHTVMDSDKILVMNSGRVEEFNHPYLLLQNVHGVLHNLVDATGPSTA

SEQ ID NO: 262 - protein, 1284 aa, Diabrotica virgifera virgifera
MDSTKETYNPNPRDSSNIFSILFFGFTYPIFKKGMKKDFDVEDLYNPLKNDRSTLLGDKLERNWDKQKLKPKGKPSLLRAVAITYWYEYLRLGFLTLIGDVFIRVSQPYVLGLLLTYYNPHSKTTKEQALGYAGMIVTFNTLTSFIKNQYMMNSMHAGMRVRTSVCALIYRKAIKLSTTALGKSSVGKIVNLLSNDVSRFDSASMLLHQMWVGPVSAIIIMYIIFQDIGWSGATGVVTIVTIMPMQAYIGKLSAKYRRIIAGKTDERIRLMNEVIGGIQVIKMYAWEIPFTKLISLARKAEINVIRRSAYIRGVFMAFNLFNNRFALFATLATMVFTNKAITAARVYVFMSYYQILANTLAGVFVNGLTQIAELLVSINRIEEFLENEEHKELPALKRSVISNVNEEMVACKNMVASWNENSLDPVLKNLNFKLGKNTLLGVIGPVGSGKSSLLQSILGELDIVDGSLAVHGTLSYASQEPWIFSGSIRQNILFGSDFDKARYDEVLKVCELRKDFDQFPDRDFTLIGEKGANLSGGQKARINLARAIYKDADIYLLDDPLSAVDSIVSKVLYEDCINGFLAKKARILVTHQVYYLKTADHILVLNNGGIEIEGTYSELLKSDNPLTVHLTEEIEEILKRQKSQDSAIEEQEAKTMSTMDLSKMNGKMKAIVKEMQEETSKGKVKGSLFLEFFKSGMSICEIIFLVTLLTIAQASATVIDWFISFWTNIEEYQMTLNSTAANVLNSTVVDALNSTAVDAINSTAVDVLNSTTVNALNSTVVDESVPFYMNWSSQTCLIIYGAILVFCLVTTLSRSLSFYRFILNCSENLHGMLFTGVTNTYMRFFDKNPSGRILNRFSKDIGSVDEILPRMLFEASRVTLKMLGHLVLVLYVNPASVIVVIILGILFSFIRIVYLRSSNNIKRLEGRMKSPVFSHLTATLEGLTTIRAFKAQNILRAEFDKHQDSHTSAWFMFISTSSAFGFSLDVICLMFIGSLTFSLIGLGEYFNLTGGDVGLAINQASSLTQNIQFLVRFSADISNQLMSVERILEYKELIPEQQPEKLLLPPKSWPDKGIVNIEHLNMKYIDDGPTILKDVSVKINPKEKIGIVGRTGAGKSSLISAIFRLTPLEGKIYIDDINTKDITLKQLRSKVSIIPQDPILFSGTLRYNLDPFDEYSDETLYRALNEVELKDPSNIINRLENRVMDRGSNYSVGQRQLICLARAIIRNNKILVLDEATANVDPQTDALIQRTIREKFADCTVLTVAHRLNTIIDNDRILVLEAGE

SEQ ID NO: 263 - protein, 968 aa, Diabrotica virgifera virgifera
MSNKIVTLAFRTEAKKFLTVLHKPLAYNRNKNWFSRTSKVPLPLGKESRNVPGSVPFKNRRTNLLRLPQSVAVSVGRSQHYCCSEWLSSISYSKRRLSVQKTSKNMPEGKPFERLPQNVKPKNYRLSLVPDLTALTFQGNVSIEVEVVSNTDTVVLNSLDLKLNEVTLKGDKSLKPGQVELCAEEEIATLKFPSLVTPGSYILDIAFTGEINDKMKGLYRSKYVNQKGEETYAAVTQFESTDARRCFPCWDEPAHKATFEISLTVPKNLVALSNMPVKNSQPEGDLIKYDFEKTPIMSTYLVAAVIGEYDYVEDKSSDGVLVRVYTPKGKKEQGLFALEVATKVLPYYKEYFNIAYPLPKIDLIAIADFCAGAMENWGLVTYRETCLLVDPKNTSAVSKQWIALVVGHELAHQWFGNLVTMEWWTHLWLNEGYASFVEFLCVNYLFPEYDIWTQFVNDSYIKALELDSLKNSHPIEVPVGNPSEIDEIFDDISYNKGASVIRMLHHYIGDEDFRKGMHLYLTRHQYKNTFTENLWAALEEASQKPVGDVMSFWTKQKGFPVVKVTQQPAGDGGGVKLTLSQSKFTADGSSPADEDYLWMIPISISTSKHPSKEVVCIVLTTRTAEIVVPEVGKSDWIKVNPGAIGFYRTQYTPEMLEKFIPAIRDRSLPPLDRLGLLDDLFAMVKAGHTSTVEVLKLLNAYEDEPDYNVWCSIVNVLGRLGQLLGHTEYEADYNKFQKRLLSKVYSRLGWTQKSGETHLDTLLRGLVLGRLAWLDHEHTISEARNIFDTHVKSEQVLPADLRSACYKTILRAGGEAEYDTLLQLYRSSDLHEEKDRISRAFGATKDPKLLKKVLEFAMSDEVRSQDTVFVIASVGLNSTGRDIAWQFFKDNWPQIRERFYGSLLTRLVKYLTENFASDERAKEVEAFFAEHKPPGTERTVQQSIETINLNTTWLNRDSAAIKEYLRTI

SEQ ID NO: 264 - protein, 766 aa, Diabrotica virgifera virgifera
MSKDSRYTPVNTNPDKNPTWWKRRTSMERCLTLSTGIALLIGISLLIALATVLYSRDQHVSNKPYTAQPLQGKIVTITSQDHEDEKVCLSPGCIHTASRVLEYMDESVDPCDDFYQFTCGNFIKKTNIPDDKSSVTSFTLIGDELQEQLRTMIEEPIQEDEPKPFKLTKKLYKACMNKTLIEEDGMTTITEVLKELGGWPVLEGDSWNEDDFDWKNSVYKFRKVGYGVDYFIDFSVVGDVKNSTKRVIDLDQASLGLRREFLIKGLDEKIVKAYYDYMVDLAVLFGAERERAAKELRASLEFEIQLAKISLPSEKRRNMTALYNPMTIEQLQEKFRSIPWVEYINNLLAPDTTVESGEIVVVNVPSYLKAFETLVSKTPKRVQANYVMWRAASNSVSYLTERLRKRQLDYTAVITGKTEREPRWKECIDITSVSLSIASGALYVRKYFNEQARQNAIDMVKDIRAEFQDILKVVDWMDEETRENALEKAKSMTSHIAYPDELLDDEKLKEFYDGLEMDRNQYFKSILNLTLFGTRFSFKRLRQPVNKTDWITHGRPAIVNAFYSSIENSIQFPAGILQGVFFNADRPRYMNYGAIGFVIGHEITHGFDDQGRQFDKVGNLVDWWQETTKKRFVEKAQCIIDQYANYTVPELNLNLNGINTQGENIADNGGIKEAYLAYDRWVKRNGEEYFLPGLNYTGRQMFWMSAASIWCSVTRKEELQQMIITDEHVPDKFRVNGPLANMKYFADDFNCRKGAPMNPEHKCQVW

SEQ ID NO: 265 - protein, 929 aa, Diabrotica virgifera virgifera
MTPLSFLSVLLVFLPFVYLQEYRLPKTVVPSHYALSFTFNRQVFAGTIFEFSGSTVITIKTSESVANIQLHADPSFLRIGAISLDQGGEIDSYNVDAVTQILTITTKAALNPEIEYKLTITYRADISTKEMIGLYQSTYQDANQATNYLVATQLEPTYARRVFPCFDEPSFKATFQVSFTLGPNITPRTNTKLESSNQMTPSILQYTFVTTPVMSTYLLSFVISNLDCTDAATINGVQNSVCSRPGTENLRDWAVNIAPKILASLGEYTKLDYNLAMNKMDYVAIPDFSVEAMENWGLSTYREQSLLYDPEHSTNIDKQNVATLLAHEIAHQWFGNLVTCNWWSETFLNEAFGDYFEYFAAHMILPAWQLDKQHVVNNVQKALRADEGNLPALQSTVSSPVEILGRFNVVSYTKGSSILRMVEHILGSENFKDGIYHYLNSHKFKSTTSSDLWRGFQAYLDNSYSILPNYLNLGAVMNNWVVQSGFPLVTVTVSEGNVQIEQRRFGDNGTDDNSKWYVPITFITSGSSGVPSTRPSYWLTPENNVAFQLPQGAEWIIVNNLQTGYYRVNYDTATWNKIEEVFKSNNFGSINEITRAQIVDDLFSLANIGEISYSRVLKFLEFLSEETSYFTWTSAFNGFQFLFNRLQNQSNLTETVTSNVLSLMDKLYKSTPFDVIDDDNQVFTLKKMLTLSWACQLGHPECLVMSRASFLSYKLSGVKPQKNLRSTIYCTALQTSSERENWDFLLKVHNEADLDSERPLLLKSLACTQNKELLQELLLLTIADDSPIAREDCITVLGSVAANSNGAEQAFDFVINNYDNITQRYQATNTIANILEIIGGAITTEEQVDKFRSFINGGQLPKDYVNDGERALEIAQKNLNWSEKHEKDLINHYYPESKEPDEPQPYTGEGVSIGSNGLIIGFIVSYLLL

SEQ ID NO: 266 - protein, 868 aa, Diabrotica virgifera virgifera
MEKNNCEKNCNRDQLAKYRLPDTVKPLLYDLYLYPDLKTGLFTGKVNISLEILKETESVSLHSKGLNIANVKVASQPGIFTIEKTYDLLNIKRQDNSKFIPGFDNVEIEFNGDMKNRIVGLYTSSYTTSSGEKRQIATSKFEPTFARQAYPCFDEPNLKAKYKVHLLKPKDSSYIALSNYPVENVTDYDNDHQLVTFDETVSMSTYLSCFIVSDFTHTETSFNNSGKIVPLKVFASPENLDKTRYAGEVGKKVIEYYVQYFQMPYPLPKLDLVAIPDFVSGAMEHWGLVTFRETALLYTNTTHSSLNKQRVATVVAHELAHSWFGNLVTMNWWNDLWLNEGFASYIEYKGVLAAEPTWGMLEQFIITDLHPVLSFDAKLSSHPIVKHVVTPDQITEIFDVISYNKGASILRMLEATVGDEVFQNGVKNYLNRYAFGNAVTKDLLSELQLLVGNKLDVTEMMDTFTLQMGYPILDVAISGDTYTLTQKRFLKDPNAVYNVNETKYKYRWSVPVTYVTNLGKSSEFILFKYSDNQVTIKKPAGATWLKFNTDQIGYYRVNYPLDEWQNIINNYKLFSTGDRTHLLEETFCIAEANQLNYTIPLELTKKLKDEIDFTPWSVATSNLKDILARLRGAKSDMISAYKEYITKIVSPAYNKFTWTEDASDKHLEKLARLRVLSLACSADHKEALEEARSKFNTWIETKQPISPNLRSLVYVYGIKNASESDWDNMLQVYMNETDASEKVKLMDGLSSVDNVNLLKKLLDLVKNESVVRSQDYLIVLGTISINPKGTDLVWDFVRSNWDYLVGRYTLNERNLGNLIPRITNNFYTPDRLQEIEDFFKKYPEAGAGAIKRKEALETVRNNILWVSN

SEQ ID NO: 267 - protein, 557 aa, Diabrotica virgifera virgifera
ATYMASLALEDLFPQWNSLEEEDADNILDVFSFDALRTSHPVSVPIGNPKEIDEIFDTISYKKGSSLIRMMTLFLGEEILRKGVSNYLKKHKYGNAEQDDLWEALTKEAHSQNVLPKNLTVKLIMDTWTVQTGYPVINVMRDYSKKSASISQHRHLRDIIYPKDASKPCWWVPLSYSTKSNPNFNSTTPKHWLSCPEHSQTIEDLGDENDWVIFNNKMAGIYKVNYDERNWNMITKFLQGPDFQTIPTLNRVQIISDAADLAYIGSLKYEIFFEMLKYLKKETEYMPWKAAIDKTDVITKHLKKSASYGKYKEYMRHLLTPIYEKFGGFEVTTDPEKLDYIKLQALIVSRSCAFEVANCVSQAKSLFNKLKEKQSDNVIPKDLRSAVYCTVLKHGGEAEWDFLWNKYQNSNVATEKSTILTNLGCTEEIWMLARYLDWSLNDTQIRRQDSSSVFASVSRNNVGYFIAKNYFYNNIDKVYKHLLTNKKTLSRYLSALSNQITDAKDEKEFERFIKGNKKTFAEVKKGVEQSLETVKINIQWQHTHAEEIADILNKYSK

SEQ ID NO: 268 - protein, 679 aa, Diabrotica virgifera virgifera
MWSSKISRTSFTTLDIYRRITRGVTNLAKSRQASTSDIHLFKVGEKYHGFEAKRIASIPELKTTALYLLHEKTKAQYLHLYRNDSNNVFSVNLRTTPMNSTGLPHILEHTVLCGSEIFPVRDPFFKMLNRSLATFMNAMTGPDYTMYPFSTLNYTDYLNLQKVYLDAVFRPQLKELDFMQEGWRLENVDPNDVNSDIIIKGIVYNEMKGVFASNDSILGQKLQNLILPSHTYGVISGGDPQEIPNLTWNDLKNFHKQHYHPSNSRLFSYGNFPLLPSLEYIDKEYLSKYAYSPPTHTVVPKEKRWEAAKREHIKCRYDVLGAPFEKQNTISISVLASDTTDAYQTLVVDFLTNLLIKGPNAPFYQSMIEPNISGGFTASTGFDNQPRDGMVTIGLQSVKKEDFDKVISIFEQTVDKVIEKGFEPHHIEMVLHSYELSLAHESSNYGLGLLFGISTAWNHTENIIEHLQSRKWIDRLKQDIKTNPNFLQDNVRKIFKDNQHKLILTMSADKDFEAELAKAENQLIKQKTKGLSSKDKKVIHEKALELQKQQMEPTRTELLPTLLIDDISSDVEKVDMEKVSLNNVPTQINKVNSNGIVYFKAMLNTNYLSPDQQMLLPLFCFTISKLGTDKLNYKEFDSLINRKTGGLTLNSHIGESLYSLHTYQPSLLLSSYALERNVE

SEQ ID NO: 269 - protein, 695 aa, Diabrotica virgifera virgifera
MFKYYFVVLCFSLYFAVGCFECLTYRLNPSEAVPITYEIVIKPDLDNDVFHGEVIIYVVTKISLNGITLHSDELNITDVYINQIKGCYVEETEERITVKYNNGPLQPGEHTLLFKYSGKIRPSHGLIKALYEYKDTKEYVYVTDLEPNKARRVFPCFDEPQFKAKYHIKLVSPNETYAAISNMPEITKFRTSYGIVHEFAASVPMSTYLVSFAFTNFPYYSENFEYQGRQIPIRIFTVNASKENNEFAMQCVKTALSFYSDYTDISYPLPKLDMIEYKREESAATENWGLITFRQGLLTTPLRIYSKFQIKLVAFHELSHFWFGNLVTNAWWNDIWLQEGFATYMSYKLSAQDNNNTQLDEMKSYNFNEFFETEIYEKSQPIVQYLPDPSKIADVFNGLVYEKASAILLMLEDEIGQEKFKEIIRTFLKKYAYHTATTNDFITVVEEVVSDIPLRTFLESYLYQNKFPVLNVDIVNNSTYVITQQICETVQQEPISATKWTIPISYQTDYSNDSKHVWFHREMEELRLEEADAKWIIFNPEGNQMYKAIWSTNIWNKIISNFDLMDYSTTDTVISDAYYSFRFNKIKCEIVIHLMEQLKPEHKRKWILFYAFYDHLKENLFCHKYTEEATLFWKFLKRRFSETNYPKTPKLRKPESCDNQYIIQNEDYRKNLDQCATWIRENLKEKDSNAIKTIL

SEQ ID NO: 270 - protein, 610 aa, Diabrotica virgifera virgifera
MVKAGLSPCDPSSFSRPDQVIVTELFLNLDVNFESKTLHGHAILSINKIDETATELVLDTFKLNITSIFDADKNCTEKLEYTLSDHLEDFGSKLTIQLPQKEVKKIHIEYETAPDASGLQWLQPQTTAGKIHPFLFSQFQPTHARSVIPCQDTPAVKHPYRATISAPKELEVLMSAINEGSKVIGDKKQYSFYQQIPVPSYLIALAVGALESRRLGPRSHVWAEKELIEESAYEFAETEHQLKTAEDICGPYVWGIYDLLVLPPSFPYGGMENPCLTFVTPTLLAGDRSLANVIAHEISHSWTGNLVTNKTFEHFWLNEGFTMLVERKIISRLVSPQMQDFDAYTGISDLKEAIEVLGADSPLTNLIVDLKGVHPDEAFSTVPYEKGQTFLRYLEKTVGGPDKFEPFLRSYFDTFKYKSIDTTDFKNFFENYFESEPEIKNIDWDKWLHTPGMPLTIPDYDTSLAEACDQLLEKFYNWTGEGSLPISAEDKQQLIPEQLIYFLQKLSEAESQPIPKLVALNELFGFDGVKNSEIKFRWLKTGIKAKWEVQIQNALDWVNVVGRMKFVKPLYRELFQWEVSRNRAIENFKSNRHNMMHVCATTLAKELKIE

SEQ ID NO: 271 - protein, 631 aa, Diabrotica virgifera virgifera
  misc_feature (281)..(281): Xaa can be any naturally occurring amino acid
ELKQEYYRLVTAQVKSSEQFEVAEKKKVVRAISLAESSTGSDHNIEATKEDNEDDFNENKDVSVFEILKMNAPEWPYILFAGLGSIVVGCGMPVFAVLFGSILGTLANGDPDFVRSETNKYCLYFVLGGLITMVSVFTQMYLLGIAGEKMTERVRSRLFKAMIYQEIGFFDKKTNGVGALCAKLSSDASNIQGATGIRVGTILQSIATFCLAIGLSMYYEWKLGLVTAAFTPVILIAMFFERRNTRGGNDSRDSALQKSTRTAVEAVGNIRTVASLGLEEXFQQLYESELMPHYKSSLKTVHWRAIVFGLSRSLLFFAYATAMYYGGFLIRDGLPYDRVFKVSQAQIMGTVSIANSLAFSPNFAKGVAAAKKVKSFLSRIPLIRDLPSSRQMVKASGNFSFSEIEFTYPTRPNVLILKGLNLDILNGKTVALVGESGCGKSTIIQLIERFYDPRSGEVKMDGVDLKDISLDSLRSHMGIVSQEPNLFNKSIAENIAYGDNSREVSMDEIIKAAKNANIHNFITGLPKGYETKLGEKAVQLSGGQKQRIAIARALVRNPKVLLLDEATSALDTESEKVVQEALNEAKKGRTCITIAHRLTTIQDADLICVVANGVIAESGSHQELLQKEGLY

SEQ ID NO: 272 - protein, 584 aa, Diabrotica virgifera virgifera
LFGMKSVGVGIGVILTTYISTVLFIYSASRQIFKIRKAFLEKTLNQDIAWFDQNRTGDFASTFTQNISKLEEGIGEKIGTFLFFESTFVAGCVLGLVKGWKLALVCMVSLPLSTTIMTIISWISTKFSAQEMESYGEAGTIAEEVFTAIKTVVAFDGQDKEIERYNKHLVDAKKNNLKRSFFTAVSNGCLWFFVYACYALSFWYGVTLILNDRHLPEHEQVYTPANMVSVFFSTLIATWNFGLGAPLLETFGTAKGAAQKIFFVLDSKPVIRKFANSGIVINDAALEVTFEDVHFSYPSRSDVKILRGINLTISKGETVALVGKSGCGKSTCIQLLQRFYDPDMGQIKINGIDIKQLNLDWLKQKISVVSQEPDLFSTTIAENIRYGKLNATQQEIENAAKKADIHTFIQTLPRGYQTVLGERGTQLSGGQKQKIAIARALVRTPEFLLLDEATSALDTTSEAEIQEALDSIRGTCTIIIVAHRLSTIRQASKIVVINEGKVLEMGTHTELMDMKGAYHNLVISQGLTETLEEKGNRRRSRKFSEANKSINEKEDEELEDTQINQPVAKNILWKVLKLNASEWF

SEQ ID NO: 273 - protein, 528 aa, Diabrotica virgifera virgifera
MVSTKNFVILIIATVVHQIRPVINIKEGQNFWKQRGYLELDEAINKKIIDGPANNVILFVADGMGMTTMTSSRIYGKGEQGSLAWEKFNNIGILKIYSANKLVPDSCSTATALFCGVKANHKTAGVDATVDVNDCDAAMKEESHLESIMTWAQAAEKSTGFVTTTRVTHATPSALYAHIPNRSWECESKIPQNSTKCKDIAKQLIQDMPGKKIQVIMGGGRQCLQSSVPDSPADPVDTWSCYSKDGRDLITDWKKDKEKNGYTYQVVNNNEELQNLDLQKEYTLGVFANGHLKYDYERDKGPKGMPSLANMTEKAIQLLQNNKNGYVLMVEGGMIDQAHHRGHARKALGETIGFSDAIERALELTDPSETLIIVTSDHSHSMILTGYPDRGRGVLSYTNSAMDNLPFTSLLYGTGGPNNYQFVLDNNTATRIDPSKNNTGDWEYSQQALVLTDEVTHSGADVLVFARGPMAHLFNSVHEQTYVAYVIAYATKIGPYSDSTNGSVGFSDFKYIHVITIFLIVASFVIGD

SEQ ID NO: 274 - protein, 315 aa, Diabrotica virgifera virgifera
KLPVSVVPTHYKIHLLPDLSDFTFKGEVSINIEVKTSTHEIKLHSLDLELNSITLKHEGEQYTPIDTKLHTEEEMAVFKFKSSLTPGNYTLDIAFSGKLEDNMKGFYRSKHVDEKGAEFYSAVSHFAPTDARRSFPCWDEPAIKATFDVSLTVPKHLLALSNMSILTSKNKGELIKYTFHTSPKMSTYLVAYAVGEFDFVEKISSDGVLIRVYTPLGKKEQGEFALDVATKVLPYYKQYFDIAYPLPKLDLIAVGSLGFSAMENWGLITYRENRVLIDPQNSSNSTKQGVALVVAHELAHQWFGNLVTMKWWTDL

SEQ ID NO: 275 - protein, 312 aa, Diabrotica virgifera virgifera
VNHAKTIANIINGLYSPLNIFIALVGVVIWTENDEINFSPNGDTTLTNFLHYRREKLIKSHPNDNAQLLTKFNFDHGVVGKALKGPICTYEFSGGVNTDHSPVVGLVATTVAHEMGHNFGMEHDTNECECPDDRCIMAPSSSTVAPKHWSSCSLNYLLQAFTHGMDYCLKNKPKALFDSPVCGNGFVEPGEQCDCGLEEHCDNYCCNATTCMLHSNASCATGECCDLTTCLPKGAGTLCRSADYECDLPEYCTGQSEYCPEDNYKLDTEVCDDGKAFCYHGFCSTRSDQCKLLWGETGKSSDDQCYMMNTKG

SEQ ID NO: 276 - protein, 283 aa, Diabrotica virgifera virgifera
AHEIGHNFGSPHDYPPECRPGGPNGNYIMFASATSGDRPNNSKFSSCSVGNISNVLDAIEEKKKRNCFTASAGAFCGNKIVEAGEECDCGYDDKECNDQCCYPRVISVRDKELNRSAVGCTRRAGTECSPSQGPCCSGECKFISSYRQEVCKMESDCSRSSKCNGSSAECPVPTPRADKTRCNNGTQLCIKGECSGSICLEWNLEACSLTTQDHPNIDKRKLCELACQNGTDICRSTSEFADRVGLPPGGISLRPGSPCDNFQGYCDVFLKCAPVQEPILRLT

SEQ ID NO: 277 - protein, 302 aa, Diabrotica virgifera virgifera
  misc_feature (20)..(20): Xaa can be any naturally occurring amino acid
PLDHLNLNQAGYYRVNYDDXLWTRIINTLHGQDKNKIPVLNRAQLIDDIFSLARAGKVDYKKAFELLDYLKYETEYYPWASALRTTSHILEHVNDKTKVLLKSKLLTLINAAFPSVTEIKSSKHVDILKEHLILHWKCFLDDNNCLNSAKVKFEEFKNSNSFQNNNERDIGLSFGVRTSNNVFYDFNFLMTHYEQLKSRVEQESILRSLGCFVDATILENYLKEIVSEKSPIVSYDALKVFESVLSHKQGVEAALKFLEVTKSIIINKYSKILSLTDFIILLENKITTQEQYEQLKNIVTNN

SEQ ID NO: 278 - protein, 260 aa, Diabrotica virgifera virgifera
MARVVALFLIFVHATNCYRLPKDVPENYKLEIISNLGAPKDSFNFDGKVWITVTCTHPTQNITLHSKHLDIKDDDVILKDITSNDSKTVKISNVEFKEEFEFLILNLEEDLNTDHKYEIYIGFSGKMDDGLAGFYRSSYYDKKDKEKKWLGVTQFEPISARMAFPCFDEPEMKATFDISIGRKEGYTVISNMPVLRTEPLKEKDGWFWDRFDTSVPMSTYLVAWVVSDFDYKSGKLVENNNVTFRIWARKDAINQVDFAT

SEQ ID NO: 279 - protein, 294 aa, Diabrotica virgifera virgifera
WGNTEPLDYERSHNHILSVIAYDCGMRQSFPALVTIKVNRVCRLGWRGLPERVDYAPMTGKQELFPSANLELCDVPCTIRELRTRVDLATRHIGKGCDRDTYSVQSQRKLCGASPSAIDLLPNPGVGAEWTKPLISDEGHESDQMFEFDGATTAVTIPTSVLEHQLPTTFTISTWMRHGQHPTQDKHLKEHIFCTADDHKMNRHHYALFVRNCRLILLLRRDFSEGDLNIFRPAEWRWKISQVCDDQWHHFAINVRFPDIQLYIDGQLFRAEKKNPEVIDDWPLHPTKGINTTL

SEQ ID NO: 280 - protein, 262 aa, Diabrotica virgifera virgifera
EELREIISNYEYSGLYDNFLLKLVTPMYNELGTDTRVFDTQNEKLLRLHIVISACKLRYGKCITWARNIFYQWMKEEDPDAENPIPVDYRFIAQCAAIKSGGPVEWDFLWNRTRYANIAPVDLQTAYQSLGCTYDPWLINRYLEYSLSGNVSLEYVPYVWQSINHPVGVRTGFQFLRLNWNLIYKTYEEVYLVFSTIFHDFLGQFSTEADLEDLTTFYKIHQTDLKTISTILQSTVDRIKVRINWKTKHLDSVVNWLKRNRY

SEQ ID NO: 281 - protein, 224 aa, Diabrotica virgifera virgifera
MFSDCVAVLLLLLVLPFIESAERLNEYIRHYETLAYDTEAVHRAHTRAKRSIASDNYVHVAFKAHGHDFRVRLKRDLHVFQDKLEVQGPTGEPLDVDTSHIYQGHILGEPDSVAFGSIIEGVFEGKLMLPSKGAFYVEKAHHYFPHTTHPNRTFHSVIYHEDHVEDPYAHKREGHSAGCGINDDVIEWMNKIQSSGEDLPITPSTVAFKKAVKHKKHLKTKKDK

SEQ ID NO: 282 - protein, 155 aa, Diabrotica virgifera virgifera
MEMTKEKYNPNPREKANILSTLFFGYTYDVFKKGLSKTLEVDDLYNPLKIDRSKILGDHLQSNWDKQLEKAKKTNSKPSLLKAILMTYWLEYLKLGIFDITTDLVLRLIQPLMLGKLLDHFKPEAQVSKNEALMYAGIIVAINVLNFLIGNQYMV

SEQ ID NO: 283 - protein, 217 aa, Diabrotica virgifera virgifera
  misc_feature (103)..(103): Xaa can be any naturally occurring amino acid
MRTKLVIFLCLVLFVTSVYNEDIPVNSLLDELHPAAEFSRHTLVKPKLYHGREKRQISSTKEKSGKHTDHLQITMEVDGEDMILDLTINKDLIPEGFFHKHQXNGDYKIHQPTFQEANICEYNGKVRGKPNSWVALSTCDGLSGVVFDGEEMHYVEKGNSIGDVEADHFLYKYSDLLEHNKTCGYAGDAVDPEKAVHAHNNNRILRYKRDTDEQLVR

SEQ ID NO: 284 - protein, 188 aa, Diabrotica virgifera virgifera
RLNVSIIPQEPVLFSESVRYNLDPFEKYSDEILWKAIESVELKHAITDLNQTVSEGGSNFSAGQRQLLCLARAIVRNNKVLVMDEATANVDPGTDALIQKTIRERFRDCTVLTIAHRLNTVMDSDRVLVMDAGEAVEFDHPFKLLQNPDGYFSRMLRETGPAMEEMLKAVAEEDYNKKYGGIKGKKGE

SEQ ID NO: 285 - protein, 109 aa, Diabrotica virgifera virgifera
CMSVSSLKKQGPHCPDDCNGNGWCNNKGHCHCKDGFAPPTCDYPGPGGSLDSGPAADPNGQYLEKKICEITNKAAEKYLRSGINIKCLIPFCCPPKHPIRNLILKDLGD

SEQ ID NO: 286 - protein, 164 aa, Diabrotica virgifera virgifera
  misc_feature (14)..(14): Xaa can be any naturally occurring amino acid
HSDEILWKALENVXVELKGVVTDLNQPVSEGGSNFSAGQRQLICLARAIVRNNKILVMDEATANVDPQTDALIQKTIRERFRDCTVLTVAHRLNTIMDSDRVLVMDAGQAVEFDHAYRLLQNSDGYFAKFLKDAGPPMANKLRDIAKEDYYKKHTSPEVIVDDD

SEQ ID NO: 287 - protein, 179 aa, Diabrotica virgifera virgifera
DENKNTCSLYIQTDPLIWRHIREGFPEHLDPKKQQEVNEKTREEILSIIAHHVTAVNYIYRDTKFDGKSEHRNIKFEVQRIKIDDDSSCRCYHRGCGEMNQFCLENIDVSNFLNIHSLGNHEDFCLAYVFTYRDFTGGTLGLAWVASASGASGGICEKYKTYTETIGGMYQSTKRSLNT

SEQ ID NO: 288 - protein, 177 aa, Diabrotica virgifera virgifera
LVAFTISDMKSISANITAGPPVKIWAPETDLSQAQYALDVIMELLPFMEDYFDMKFPLPKLDLLAIPNFGKTAMENWGIISFRKSSVLFDPNSTSIKTRSYILAKIAHELVHQWFGNLVTMQWWSDLWLNEGLATFISEIAITTLRPKWHAYSSIKVRDTYNTLNDDSLKSARSMQR

SEQ ID NO: 289 - protein, 163 aa, Diabrotica virgifera virgifera
MGRGGYHSNRAEFLSDEAILKYSRNGGCFVTTKKAIGFVVFALISLLIVVLLMYYYGPTKTSEKIIKESNDIEKLINDTINEEATKEALRLPKSLYPLHYRLWVHPILDEHSENNFTFTGRVIIEVKCIEDTNKIILHADDLNISESDFKVYTTRQVEITTEL

SEQ ID NO: 290 - protein, 149 aa, Diabrotica virgifera virgifera
  misc_feature (31)..(31): Xaa can be any naturally occurring amino acid
DHLNFGKENSWGLLLEREENLLDEGSKTSVXEKQRIIQTLTGEIAHQWFGNYITPERWSDVWLNEGFTTFLKYHLPDLTLQELETTNQFSIEILQDALYQDSIQGEEELSTIENTAMNPKTQERMNKFKAIKGASIIRMMQSTLGRKNI

SEQ ID NO: 291 - protein, 155 aa, Diabrotica virgifera virgifera
  misc_feature (22)..(22): Xaa can be any naturally occurring amino acid
  misc_feature (38)..(38): Xaa can be any naturally occurring amino acid
WTEHPSRKKLEKPEVLSCLHQXKESLQVPSMELLQPGXMELLTNSDLTEVTVEGDNRTNLETLVRKIGYANTREFPTPGRRNLRLTTTVTCDNGKQVKVPDAQTYVMVLRPQTPSIMLNGTGNMARKYEDFRMGVRVLADIHITGEQKLDKCQLT

SEQ ID NO: 292 - protein, 145 aa, Diabrotica virgifera virgifera
DHSANYISIGSALERKFYLNGERHIFLPGEYTVAGTQALYGRDNHLEKIRIPGPIMEPIVIYIYYRGNTFNPGVEYKYSIWKQVKPIEVKYSWILGEWSQCSVTCGGGTQQREPLCQELVLERMSSEIERPNMVTNITNHKISPI

SEQ ID NO: 293 - protein, 119 aa, Diabrotica virgifera virgifera
  misc_feature (18)..(18): Xaa can be any naturally occurring amino acid
MYSTRISLFVSILAYVLXDMTSPPKKVFVITSFYSVLRQSLTVFFPQGIAQVAEVRISIQRLNKFMQFEEIDMVREKFGRCSMSSSKSLDLSKSGNGVEKSERKGELGVFLNNATAKWS

SEQ ID NO: 294 - protein, 85 aa, Diabrotica virgifera virgifera
  misc_feature (27)..(27): Xaa can be any naturally occurring amino acid
MTEEKKHSIKDKEKIGIDAQFVNSEEXKGKIKNVSFPQMFRYASTYDKFLMVVGLISATGTGVLQPLNTILFGSLTGDIIAYATS

SEQ ID NO: 295 - protein, 1474 aa, Diabrotica virgifera virgifera
MGRLHCLFCIFLCFTVINTQTTNIHGFSENSVDTFLSPHGKSAKFVHQNHKPKIENCQNYKPSVKEEQPGGTYVTTVTAIDDDPREGGGTISYKLIHREGEHVLFDIDNVTGVLTTIQPFDRDEPVRQKELYVTVQASDNGRPPLADVCTFTVTITDINDNAPQLDKLKYDAQVSEDLKVGSEVMRVFAYDIDDGENSRLSYNFSNENAQFTQYFRIDRDTGVVYLKEALTDKKNTRFNSAVYVADNGVNDQEGQKDSTAKISITVVGSDKQPPRFTQKMPDGILEIPEDFKDFSKHIVTVEATSNIADPQLAFELVKGKTYQTNKDQTFLLEAEGNKAHIKLVRPLDYETVTEYTLTIRVKNKDLMDSSINIPIKVLDVNDEIPNFLEFLKGSVVENDKPGAQAIQVRAIDKDGTAANNIVSYELVDNTDLFAINRSTGVITSRVEFDRETVPLYHVNVKAYDNSPSALYNTTLPNIVIQTFQISIEDQNDNKPVFTHPIYQFSNITELADKSSIVGEVKALDNDTASVISYSITNGNIDDAFMIENSTGRIRVNGKLDYEKIEQYNLTVRAFDGAFEDFAIVLISILNENDEPPVFDDYIREIQIKEEEPMISGCVVRVTAHDPDIKDRHADQHIVYEVAKEQKDFLTVSADGCVQVTKPLDRDPPFGSPTRQVFIYARDNDGGTNSLLATAEIEIILIDINDNAPFLNVTEIVYYENQDPGFIGNLSADDYDGPDNGPPFAFRLSDTASDSIRSKFSIIGNQLFALEMFDREEQKYYDIAIDITDSGVPPLTGTSILRVIIGDVNDNPATDGNSTIFVYKYVNGPENFMEIGRVYVTDLDDWDLNDKVFVQEDNFDEFVLNQHNNGMILMKPTTAEGTYEVHYRVTETHEPTIHEHTVNAIVTITVKVLPEEAVVKSGSIRLRGTTKEEFIENSLNGKSKRDILHQELSKILNTSLANVDVFTVLNSPHQNSSFVDVRFSAHGSPYYAPEKLENKVTDHQMELEQKLDVEFYMINVNECLNETTCGAENSCTNKLNITREPAVVFTNRTSFVGVNAFIDPVCAALPRDVMECFNGGVLIENTACNCPAGFEGPHCEILAIGFTGTGWAMYPSFDATNRTEIILHILSQTDNGLIFYNGPLNIRQTSLSKDYISLELKDGYPLLQICTGSSTQEIYLKERIHKLSDGSLHKIKIGSGFDDISLEVDDCGTTCSIWTNKLHKGVIRANGPLQLGGMKNRFTDQEFKRIWDHLPPTATRFSGCIRNLTYNEFYYNLGAPSDAFQAYPDCNYAVMQAVTFGIDSNFLVAILVCVAILIILLLAVVVHRRKHDNFNEKEIDDTRENIINYEDEGGGECDTNYDLSVFHQNNIVDEKPLMRDNPDVPADISGFLDNKKDNCDKDPDNLPYDDVRHYAYEGDGNSTGSLSSLASCTDEGDLKFNYLSSFGPRFRKLADMYGEDPSDEDSHDGNEESWC

SEQ ID NO: 296 - protein, 1333 aa, Diabrotica speciosa
MAKQEENFFHKDRKKPNILSRIFFCWICPVLVKGNRRDVVEDDLIVPSKIYNSKQQGDKLEKSWSAEVQLAQRENRNPSLWAALRRAYWLEYMTGAIYILTITAVRIVQPMLFAQLLSYWTVDSEMTSFDAGVYALALLGLNFVTMMCQHHNSLFVMSFSLKIKVACSAVLYRKLLRLNQVSVGEVAGGKLVNLLSNDVARFDFAFMFMHYLWIIPIQVAIVLYFLYGVGGYAPFVGLFGVMILILPIQAGLTKLTASVRRNVAIRTDKRIKLMNEIINGIQVIKMYAWEKPFQLVVKAVRAHEMSALKKAIFIRSVFLGFMLFTERSIMFFTVLMLALSGNMISATTVYPIQQFLSTILINLTMILPLAIATLSEMKVSLERIQGFLELDEREALSHKNGISNGALNRSLFSSKQGAIESDITAKKYVSTDVVETLQSEINKSAKPSEFAVDVCSVTASWKDVASEEATLKNIAMRVRHGKLCAIIGPVGSGKTSLLQLLLKELLPHAGSLAINGKVSFSCQESWLFPGTVRENILFGSTFDSQKYKEVTRVCCLVPDFNQFPYGDQSLVGERGVTLSGGQRARINLARAVYRDADIYLLDDPLSAVDANVGRLLFEGCIRGYLRKKTCLLVTHQIHYLNDSDWIVILKDGTIENMGTYDDLVKSGKDFSLLLKELQDSDDTGKEENLEKRPSMQRGMSVKSEENPEDQKEQVLEAEERAKGNLKWTVVAQYLKLVKSYPLLFLAVLTLLITQAAATFVDYWLSALTNAVDAYVQTVPEDQTPDPSLGTSLGSLTTGQYLWIHGGVILGIIVFSQLRILTFVITTMRASQNIHDKIFNNLIQAVKRFFDTSPSGRALNRFSKDLGAVDELLPRSLLETLQMYLAMTSVLVLNAIALPWTLIPTTFLVVLFVFLLRWYLQAAQAVKRLEGTTKSPVFGMINSTISGLSTIRSSNSEYRLQNQFDKAQNLHSSAFYTFLGGSSAFGLYLDVLCLVYLGLVMATFILFDFGGTIAVGSAGLAVSQSMVLTMLLQMAARFTADFLAQMTSVERTLEYAKLPKEQYIDEGPTKPPPIWPATGHITFENVYMKYGPEDPYVLKNLNIEIRSGWKVGVVGRTGAGKSSLISALFRLTNIEGAIKIDGIDTYGIAKSVLRSKISIIPQEPVLFSSTVRYNLDPFNKYSDDDLWRALEQVELKEAIPALDYKVTEGGSNFSMGQRQLLCLARAVLRSNKILIMDEATANVDPQTDALIQKTIRREFAACTVITIAHRLITIMDSDRVLVMNKGEAVEFDWPYVVLSKPDSHFNFLVKETNDSMSKVLHDIAKTKYFQENPQ

SEQ ID NO: 297 - protein, 1367 aa, Diabrotica speciosa
MNSKKQAHGQKPTQEKNKSKDSPLQKDVPGILSRFFFCWMMPLYYNGIKRDLEEFDLVPAKHQYDSKVVGDLLERKWLEEEVKAKAEGRTPSLRNVLIKTYWVSFIPGGIMQFLYVSIRTVTPLLFAQLLQYWSVNSTMSRETAVVYAVSMIAANWVAAFFNHHGNLYCQQFGMMLRVATSSLMYRKLMRMNNASLGDTAVGKVVNILSNDMQRFDMAMLFLHYVWIIPIQMAAVCYLGYLQAGPAALVGLAALIVIALPIQGYLGQLIGKLRLRIAEKTDERIKVMTEVISGIQVIKMYAWELPFQNVVSEKRGAEMKQVRIALLYRTVFLGFMMFTERAALFITVLVFILFGNTMTANIIYPLQQFMNAAHINITLVLPLVLAFTAELLVSIKRIQDFLILEDRPDLVKSSHTSSPGKLFQKSSSVFEKIEGPIRPLSFQTHSEFSDNVGKQQMPPVNRMMLRSLSQPGGDTAVELRNVTARWTSDPNLCALKNISVRIRRGKLFAIIGAVGSGKSSILQLLLKELPAANGTVSIYGNLSYASQEPWLFPSTVRENILFGLPYDAEKYKRVCRTCCLEKDFKQFPYGDQTLVGERGVSLSGGQRARINLARSVYREADIYLLDDPLSAVDANVGRLLFEGCINGYLRGSTRILVTHQIHFLKAADYIIVMNEGQIENMGTFEELTQLGKEFSTMLASLQEGKDKDGDSIGSGGSMESKEKKRPARTISVNNEVEEFEEFEAQKMQAEERASGNLRWDVVVAYFRSGGSICFILFTLFMILLASAASAATDYWVSYWSNSMAAYEESLEGATPEPGLDVQVGMFTTGQYLIIHGSLVLACILITNLRVFPFVGLCIGASKKLHNFMFSTMLKGIMRFFDTSSSGRILNRFTKDMGALDEILPRTLLDVLQINGVLLGILILNAIALYWTLIPSAVMLLLFFFMVRIYLKMAQSVKRLEGTTKSPVFGIVTSSLNGIATIRSAGAEQRLINDFDNHQDLHTAAWNGYLCGGGSFGLYLDTMCLVYLTTVIFVFLYLDFGDIIAVGSVGLAVTQSNMLTAMLQHGARMLVEFIAQLTSVERILDYTRIDTEENLFEGKIASIPTWPSNGAIIFDNVSMRYSPDEPPVLKNLNIVIQSGWKVGIVGRTGAGKSSLISALFRFAYIDGTITIGNIDTALVARQELRSKISIIPQEPVLFSATIRYNLDPFNIYSDADIWRALEQVDMKGAVPSLDFKVTEGGANFSVGQRQLLCLARAVLRSNKLLIMDEATANVDPQTDSFIQQTIRTHFASCTVLTIAHRLNTIMDSDRVLVMGAGQVLEFDHPFILLSDANGHLTSMVKETGEKNANQLLEVAREAYFQSNMKENAR

SEQ ID NO: 298 - protein, 1731 aa, Diabrotica virgifera virgifera
MYATAARVSTRKIRTLLRSSKERIMGEKLDKFLLLMWKNWLLQYRKPIQTIIEIVAPVLFSFLLVYIRSLSDPTYEHERIYKPFCAFEGNFNLSLPLFCNDPDAVQAGPSLFSNMQAGDSNFSLTILYTAPEDKYYDDVIGFFKLIPKVNTQRVISSGELERISLAGNSSYYGIEFGGDRDNVEVNIRFPGETVYQLDSIGRQNWRTNLVYPVFQSSGPRSPDNATGSAPNYFAEGFLAVQHFVTTALLLADKGITHDDPQGMFNFLMDASNPFPLIQMQRFPFASWFSDQLLTALTSMLGMIVMLSFVYTCINTVKSITTEKEKQLKESMKIMGLPNWLHWLAWFVKCFIFVIISVALMVVLLKVRWYSNTEFTVFTYADPFVLFVFLLLYCCSMITFCFALSVFFSKANTAATMAGLAWFISYAPYLFMQNNYTDLALSTKLLTSLLPNTAMAFGFQVVLMYEGTGDGVTWSTLFKPNTPDDTLSLGLIWIMIIINTIIYLLIALYIEAVFPGEYGVAEKWYFPFTKKYWCGKGAVSDYNNYNDHSANEFFETEPNLRPGIQIFNLKKAFGKKTAVRNLSLNMFENQITVLLGHNGAGKTTTMSMLTGMISPTNGTAKINGHDIRLDIAGVRNSLGLCPQHNIIFDELTVEEHLYFFSKLKGLSKSKITAEIDKYVKLLDLEPKRKEKSSTLSGGMKRKLCVGMALCGNSKVVMLDEPTAGMDPSARRVLWELLQKQKEGRTILLSTHFMDEADLLGDRIAIMAGGELQCCGSSFFLKKKYGAGYSLIMDKAKTCNPHKVTELLKKFIPEIEIHSNVGSELTYLLSENNAPVFEAMLKQIEQESNELGIRSYGISLTTMEEVFMKVGADHGQEEIYNEKQKKDKKEKNPILTSADLGPESLSPSYTGGLHLIVNQFVAMLMKKIIGTFRSWVLLAIQIFLPMINVIIVMSVPSGSVPSVLPAMPLNLARFTDPITLIERFDDPQNYTNNFYGVLNGYGMSPTNIDNITRIMLDLTATNPNVVRRSYIIGSTFTEQEFEFGIIKTIHPVITAWFNNDPYHSPGIALGMALSSVYNHYTNGHIEFVNKPLPFKAATQIDNIVGGQSQGFQFAFNIGFSMAFISSFYVIFLIRENVSKSKHLQFVSGVKVYIFWFVNIICDMFVYLLVCSVLLITIYCFQQDGFKTSGDMGRLFFLLLLFGWSFMPIYYVASLIFTVPSTGYTRMTLVGIFIGNAAFLLVEVLKTQSTNLKRIGETLDNVFLVFPHYSLATGINKCYAIYSYNTLCETVFDSCAQNNFTKDECISKFPSTVADICTNLNDNYFSWNNNGIAKNVTYSLISGVLWSILLFIIEYKFIARLMYYINQKFFPKQPILIQDEDDDVSKEKERIHMATDHDIRQTNILVVKDLTKYYNNFLAVNGLSIGIEKSECFGLLGINGAGKTTTFKMMSGDETVSYGDAWIEGKSVKTQLKQVQRNIGYCPQFDALLDDMTARETIIMYCLLRGIEFKRTQRIANFLSRDFDFHRHLDKKVKEMSGGNKRKLSTVLSLIGDPPVLFLDEPTTGMDPATKRYLWDSLCKIRDNGKCIVLTSHSMEECEALCTRIAIMVNGNFKCLGSTQHLKNKFAEGYTLTIKLKKLPESGGLVHADTESLEKYIKDKFPYAHLREKHQELLYYYITDTSMAWSTMFGILERAKRSDLNIEDYSLGQSSLEQVFLTFTKHQNPEGDDVKKKN

SEQ ID NO: 299 - protein, 1554 aa, Diabrotica virgifera virgifera
MANLTELTTLPTTVTELPKLTSNSSQQNATIEEEAYAALSSFCGSPFWDTNLTWNTNDPEFTPCFEKTVLVWIPCIFLWVFAGLEVFYIFNSKRRNIPWNWLNLSKLAITATLIVLTISDIVNSFKTAGNRGSEVNDVDIYSPLIKILTFALTGVFIFYNRKHGLQTSGLLFLFWFFVVLCAIPQFRTEIRRSQRNEILPDYYYFYTSYLIYFPLVVLMFLLNCFADKAPLERKYPQSQNPSPEESASFLSRLLFAWFDPLAWKGFRKPLETKDLWDINVEDSSRELVPVFEKYWSQTLKKAESTSPTQVAHAKFKSDSASVDFVNNKKKKQASILPALFKCFGPIYFFGALLKLIQDLLTFVSPQILGFLISYTRFNQEMWKGYLYAVLLFITATIQTLFLAQYFNRMFVVGMRIRTVLVSTIYRKALKISNSARKESTVGEIVNLMAVDAQKFMDLIGYLNMIWSAPLQICLSLYFLWKELGPSVLAGLAVMIILIPVNGFIANKIKKLQVKQMKNKDERVKLMNEILNGIKVLKLYAWEHSFEDQVLKIRNKEIKVLKQAAYLNAGTSFIWSCAPFLVSLVTFATYVLVDEKHVLDANKAYVSISLFNIIRFPLSMLPMMLSNLVQTWVSVKRINKFMNAEELDPDNVLHEPSEEPLTIENGTFSWGEGPILKDININIKKKTLTAIVGTVGSGKSSLISAFLGEMDKLSGRVNSYGKVAYVSQQAWIQNATLRDNILFGKPYDKTLYDAVVEACALNPDLEMLPAGDQTEIGEKGINLSGGQKQRVSVARAVYSNADIYFLDDPLSAVDSHVGKHIFEKVIGPHGLLKSKTKILVTHGITYLPQTEKIIVLKDGRISETGTYQELLDRKGAFAEFLLQHITEEAETEAELDELKDQLADTPLSQEVARQLVRHRSRVSESQSETGSDHIGNGSIQRLNSVDKSNHKLSIDDGKKGPKKGEKLIETEKAETGNVSWAVYKHYLKSIGLVFMLATLIFNLVYQGFSVGSNVWLGLWSDDQKIVVNDTVDTARRDMYLGVYGALGLGQAIPAIFTDVSLQLGCFAAAVIMHKKLLSGVLRSPMAFFDTVPIGRILARFSKDVETVDHDLPWFFSDTCFCVFEVVGTLAVISYSTPVFILVIIPLCFIYYFMQRFYVATSRQVKRLESVSRSPIYSHFGESVSGAHAIRAYNQQERFIVESENKVDMNQICYYPGIISNRWLAVRLEMIGNLIIFFAALFAVLKKDQAPGLVGLSVTYSLQITQTLNWLVRMTSDVETNIVAVERIKEYGEAPQEAAWEIPSKQTSPAWPEEGTVQFKNYSVRYRPGLDLVLHDLDFEIKGGEKVGIVGRTGAGKSSLTLALFRIIEAAQGNILIDGIRIDELGLHTLRSRLTIIPQDAVLFSGTLRINLDPFNKHSDEDVWRSLEHAHLKEFVKGLPAGLNHEVTEGGENLSVGQRQLICLARALLRKTKILILDEATAAVDLETDDLIQKTIRTEFKECTVLTIAHRLNTIMDSDRVIVLDKGRIAEFDSPARLLANENSIFASMSRDAGLA

SEQ ID NO: 300 - protein, 1742 aa, Helicoverpa zea; identical to SEQ ID NO: 192

SEQ ID NO: 301 - protein, 1266 aa, Helicoverpa zea; identical to SEQ ID NO: 225

SEQ ID NO: 302 - protein, 1261 aa, Pseudoplusia includens
MKDSENGWKQKPGDGDIRHRIPDLDKGEFAKDKNNDTYSEPEEKDDEVPSISFITLFRFATKMDKCFMFFAIIFSMIAACSTPINTLLLAFLLEAMVEFGKSVIAGAPDTDQFMSDLFWFAIYNTITGALLIVLSYAATTLMNISAYNQVYIIRQEYLKAALNQDFGYFDIHKNGDIASKVNSDVVKLEDGIGEKLATFIFYQASFFSSVIMALIKGWKLALLCLISFPVTMTLVGVAGLVASRLSKKEAVASGKAGAIAEEVISAIRTVYAFSGQGQEIMRYDEHLKDARKINIKKGLFNGLAMGLLFFCIFCAYALSFWFGYQLMQTDDYDVSTMIAVFFGVMTGSANFGISSTLMEVFGVARGAGAQIFHIIDNVPTINPLLNKGTAPASIEGSIELKNVVFHYPSRPDVPVLKGVSISVQRGQSVALVGHSGCGKSTIIQLISRFYDVIDGSVAVDGHDVRNLQVRWLREQIGLVGQEPVLFNTTVRENIRYGREDASNEEIEKCARQANAHHFIMKLPKGYDTLVGERGASLSGGQKQRIAIARALVRNPKILLLDEATSALDTSSEAKVQKALDRAQEGRTTIVVAHRLSTIRNVDVIYVFKGGNVVESGSHDLLMSQKGHYYDMVMLQNLGAEENTESKGLSREQSVRSEKEDEDDFLGNAADPEEDDEAAPDVPFTTVLKLNSPEWKSVTAASVCSLLSGFAMPLLAVIFGDFIGVLSSPDDDEILASVRRYALIFVGIGVFSGITNFIVVFLYGIAGEYLTERLRRQMFEKLLQQEVAFYDDKNNSTGALCARLSGEAAAVQGATGQRIGTVLQALGTFGFALVLSLIYEWRVGLVALTFVPIITFVLYKQGRMTYAESAGTAKTMEASSKIAVEAVANVRTVASLGREDTFRKEYAKQLLPALVMAKRSTHWRGIVFGLSRGIFNFVIASSLYYGGTLIVSEGLDYSVVFKSAQALLMGASSAAQAFAFAPNFQKGIKAAGRVINLLNRQSKITDPAHPAYPAFKGTGEASLQNVQFRYPTRPMVQVLKSLNLEIERGKTLALVGASGCGKSTVIQLLERYYDPEGGIVAQDGVPLTKLRLIDSRRAIGFVQQEPILFDRTIGENIAYGNNEKNVTADEVIDAAKQANIHNFITSLPLGYETNIGSKGTQLSGGQKQRVAIARALIRRPKMLLLDEATSALDTESEKVVQEALDAAKAGRTCVMIAHRLSTVRDADVICVIHDGQVAEMGTHDELIKLKGLYYNLNRRGYA

SEQ ID NO: 303 - protein, 1344 aa, Pseudoplusia includens
MESEIKNPQISINVLPAPETPKKRHKPNIFSTIFIWWMCPVLINGNKRDVEEEDLITPSKAYDSERQGDYFERYWLAEVERAASENREPSLWSAMRRAYWVQYMPSAIYILIITTARTAQPLVFAELLSYWSVDSTMSTYDAGFYALAMLGLNFISLMCQHHNSLFVVRFGMKVKVACSSLLYRKLLRLSQVSVGEVAGGKLVNLLSNDIARFDYAFMFLHYLWIVPIQAAVVLYFLYDVAGYAPFVGLFGVVIFILPLQAALTKLTAVIRRSTAKRTDKRIKLMNEIINGIQVIKMYAWEKPFQLVVKLARAYEMTALKKSIFVRSMFLGFMLFTERSIMFFTILTLALTGTMISATIIYPIQQFFSIIQMNVTLILPLAIASFSEMLVSCERIQSFLILEERSDMQVTPKIIGGKNKLFNSKNGHLEPGDVLPKKYVPSELSVTKPAEEPVQSDYPIVINRVSASWTGSNKPEDVTLKNISMRVRKGKLCAVIGPVGSGKTSLLQLLLRELPLMDGTLNVKGKLSYACQESWLFPGTVRENILFGLPYDVTRYKEVCKAACLVPDFKQFPYGDLSLVGERGVSLSGGQRARINLARAIYREADIYLLDDPLSAVDANVGRQLFDGCIKGYLAGRTCVLVTHQIHYLKTADYIVVLHEGAIENMGSYDELAKSGTEFSNLLSDQAGNSDVTDVKTNRPAMLRGISKISVKSQEEQDEEEKAQVLEAEERGTGSLKFEVIWSYIKAVQSWTIVILALVSLMITQGAATTADYWLSFWTNQVSEYEISLEPGQLPDTSLDAQIGLLTTAQYLIVLGSVIGGIIIISHLRILAFVVMTMRASQNLHNIIYEQLIIAVMRFFDTNPSGRVLNRFSKDMGAMDELLPRSILETIQMYLSLASVLILNAIALPWTLIPTAVLLVVFVFFLRWYISAAQAVKRLEGTTKSPVFGMISSTISGLSTIRSSDSQTRLLRTFDSAQDLHTSAFYTFMGGSTAFGMYLDAMCLAYLGVVLAIFLLGDFSDIIPVGSVGLAVSQSMVLTLMLQMAARFTADFLGQMTAVERVLDYTKLPSEENMETGPTTPPNDWPKVGQVAFNNVYLNYSPDDPPVLKNLNFVIQSGWKVGVVGRTGAGKSSLISALFRLSNITGHITIDGLDTEGIAKKVLRSKISIIPQEPVLFSATLRYNLDPFNNYSDEDIWRALEQVELKDGIQSLEFKVTEGGSNFSMGQRQLICLARAVLRSNKILIMDEATANVDPQTDALIQTTIRREFAACTVLTIAHRLNTIMDSDRVLVMDKGEAVEFDHPHILLSDPNSIFSSMVRETGENMAKVLFDVAKNKYDSDNKTA

SEQ ID NO: 304 - protein, 1367 aa, Pseudoplusia includens
MTEKMGTKKEENTGTKSSPPPQPKTVPNVLSRSFFCWVFPLFYFGNRRDLEEYDLVPPRHIYDSKLVGDQLERVWYEEEKKAKLQGKTPSFTRVLIKTFGWSFLPGGIIQFISIALRTASPLLFSELLKYWSTESDMSRETAMYYAITMILFNWASSYANHHGLLFCQQFGMKLRVATGSLMFRKIMRMSNGSLGETTAGKVVNLLSNDLQRFDLATMFLHYVWIIPIQLAAVVYLGYVQAGTAALIGFASLIVIALPIQGVLGKALGAIRLRTAEKTDERIKLMSEVINGIQVIKMYAWEIPFQKVVGEKRAVEMGEVVKGTRLRTVFIGFMQFTERSALFITVLMFILFGNSMSANVFYPLQQFMNAAQINITLFLPLVITFTAELYVSLGRVQEFLSLQDRPDLSEKTEYIESSNLFRNMSTKRNSTQQVRPLSYQQKSNGFAVDEMVEKPVIPYNRRFSRSVSVQEDCALKLHDVSASWTGDPNMMAIKNVSMRLRKGKLCAIIGPVGSGKSSILQLLLKELPPASGSVSIYGQISYACQEAWLFPSTVRENILFGLPYEPEKYKKVCKVCTLEKDFKQFPYGDQTLVGERGVSLSGGQRARINLARAVYREADIYLLDDPLSAVDANVGRLLFEGCINGYLRKRTRILVTHQIHFLKAADFIVVLNEGRIENMGTFDELVGSGKDFAQMLAGLQEGKDKDAESLGSHASLEDKPRPALKTMASVNEGEDLEEFEEQKKEQEERSSGNLRWEVVLTYFKSGGNLCFVLFTVGVVLLAVASGASVDYWVSYWTNQMAVHDATGGGSTDSDSGPNFDEQVGLFTTGQYLIIHGCLVLSCIFLTNMRVFPFAHLCNTASINLHNNMFSTMLRGVMRFFDTSDSGRILNRFTKDMGALDEILPRTLLDVIQMYGSLVAIFVLNAIALYWTLVPSAVLGTLFFFMVRVYKKAAQGIKRLEGTTKSPMFGVVTSSLNGIATIRSSNSQDRLIEQFDTDQDLHSSAWNCFLSGGATFGFYLDTICLVYLTAVIFVFLFLDFGESVPVGSVGLAVTQSNVLVMLLPHAARVLVEFLAQLTSVERILQYTHIDTEPNLFQGKIDMPPTWPSRGSLIFQNVSMRYAPTEEPVLKNLNIVVESGWKVGIVGRTGAGKSSLISALFRFAHIEGSISIDGIDTSLISRQGLRSKISIIPQEPILFSASIRYNLDPFNSFSDDDLWRALEQVDLKPVIPSLDFKVTEGGSNFSVGQRQLMCLARAVLRSNQILVMDEATANVDPQTDNFIQETIRRRFASCTVLTIAHRLNTIMDSDRVLVMSSGEVAEFDHPYVLLSDPNSHFSSMVRETGEKNSANLLRIAKDAYFQSNLKENAR

SEQ ID NO: 305 - protein, 1635 aa, Spodoptera frugiperda
MRLVPKQASPFAKFRLLMWKNFLQQWRHRTQTVLEILLPVLTMTLVLILRWQIEPAERETQTYPPFRANTLNFSTVVLFGLDCPNVSIAYSPTSPVLEDVVRNAITNLLIQNMEDLIARLPIEIELPPTIEINSTAILDWIKSRIRVQAYNNSHETRGIYIEEENTRRVIAVVEFDDKLYGAESLSNNLSYSLRFPERPRLNSLFQTGGRTWRTDAVFPVFETPGPRFSKSWEGGNDPGYVNEMFIALQQVISTELISRSTGVNMSEFTVFLQRYPHPPYIRDMALDLLQFMFPMFIMLSFSYTAINITRAVTVEKELQLKETMKIMGLPTWLHWTAWTCKQFVFLLVSASLTVILLKINWFTNEDGFSEYTVFTNTPWTVLMFFTMLYLTCVIFFSFMMSSFFSKASTAALCTVVVWFLTYIPAFLLAMDIEMSTTVQVFTCLSINSAMSYGFQLLLAKESTGGLQWGDFMSAPGTDSNRFVFGHVVIMLVVDCFVYMLVTLYFEQVMPGPFGTPKRWYFPFQLRFWFPHYKPGTVLVLENENSEFEDIIKEKEPNEHEVGVKMNNLTKIFGANTAVNNLSLNIYDDQITVLLGHNGAGKSTTISMLTGNLEVTRGTVTVAGYDMTHETYAARAHIGLCPQHNVLFNELTVREHLEFFARLKGFRGAELKSEIDTLIEKLELQDKRDYPSNGLSGGQKRRLCVGIALSGAARVVLLDEPTSGMDPSSRRALWELLQKEKKGRSMILTTHFMDEADILGDRVAIMAQGRLQCVGSPYFLKRHYGVGYTLVVVKDDDFDFEECTRLINKYIPDTVVKEDRGTEITYNLINDYSYAFEEMLNDLECNMEKIKYKNYGLTATTLEDVFMSVGSDLAPVNNSDNDDAVTTTTDSTIDDILKHELDSSLEELDRDESNVTGFRLLCQQVLAVWMKKGLTLIRSPWLMILQFFAPVILINATLGVMRYVMSLTPTIRSRFLSLTEGFTSTETLLSFNGTLGSSVGAIAAAAYEMMFTASDVENMGVTRIGNVPMDEYYLNRTMDPVVMGQLRHQILIGSTFDDNNATLWFSNFGYHDVAIALSTFHSAFLRAFNSTAQLNVYNHPLEATYRDQTDMQMMIAMLSMQLSSGIGSSVSIVSAVFIMFFIKERTSGAKLLQKAAGVQPAVLWGSAAVFNWAWFLITCVSIVITCAAFQVIGLSTAQELARMYLCVMLYGAAMLPLVYILSFAFNGPAVGFVGYYFMNVLFGMMGAQIVEALSSPQLNTAEAANILDYILQFFPLYSLITAVRFLNQVGLREYTCLQMCEYYQAVSPNLQCTMESLCSRNEECCVEPNVYFKWNQPGVSRYLTSMIISCIVFWTILMIIEYRVFQKLCTIKKTPPPLDESILDEDVQKEAQRARNVLPSQRYEHALIANDLSKYYGKHLAVNQISFGVNDGECFGLLGVNGAGKTTTFKMLMGDESISSGEAFVSGHSVEKSLGKVHQNIGYCPQFDALFGELTGRETLHMFAMMKGLRLRSAAPTAETLAHALGFLKHLDKRVNQYSGGTKRKLNTAIAFLGRTRLVFVDEPTTGVDPAAKRHVWRATRGVQRAGRGVVLTSHSMEECEALCSRLTIMVNGRFQCFGTPQHLKNKFSEGFHVNY

SEQ ID NO: 306 - protein, 1261 aa, Spodoptera frugiperda
MKDSKGNAWQLKPGEKENENKLPDPLNEDVQKGQFSDTSSEPSEAKAEEVPSIPFITLFRFASTRDKLFITCALICSAVAAVSTPLNTLLLAYLLEAMVNYSIFGDADAFMKSLLNFAIYNAAVGAALVVLSYAATTLMNIAAYNQVYVIRQEYLKAALNQDFGYFDVHKNAEIANKMNSDIMKLEEGIGEKLATFFFYQASFLSSVIMALVKGWKLALLCLISFPVTMTLVGVAGLIAASLSKKEAIATGKAGAIAEEVISAIRTVYAFSGQEKELDRYEGHLNDARKINVKKSLFNGLAMGCLFFCIFCAYALSFWFGYRLMVTDGYDVSTMIAVFFGVMTGSANFGISSTLMEVFGSARGAGAHIFNMIDNVPTINPLQNRGTVPSDIEGNIELKNVEFHYPSRPDVPVLKGVSIKVKRGQSVALVGHSGCGKSTIIQLISRFYDVVEGSVAIDGNDVRDLSVRWLREQIGLVGQEPVLFNTTVRENIRYGRENATNEEIEACARQANAHQFIMKLPKGYDTLVGERGASLSGGQKQRIAIARALVRNPKILLLDEATSALDTSSEAKVQKALDKAQEGRTTIVVAHRLSTIRNVDVIYVFKAGLVVECGNHTELMASKGHYYDMVMLQNLPGVDEQSPEKTKLSRETSIISEKDDEDEFLEFRNDDKEEDAAEAPDISFMRVLKLNKPEWKSVTLASICSLMSGFCMPLFAVIFGDFLALLDGDDPDEIQKGVSRLALIFVGIGVFSGITNFIVVFFYGIAGEALTKRLRLMMFRKLLEMDIGFYDDKDNSTGALCARLSGEAAAVQGATGQRIGTVVQAVGTFGFALVLSLIFEWRVGLVALTFVPIIIFVLYKEGRMTYAATSGTVKVMETSSKIAVEAVANVRTVASLGREETFRREYSKQLRPALDTAVRSSHWRGLVFGMSRGVFNFVIASSLYYGGTIIVNEGVPFEQVFKSAQALLMGATSAAQAFAFAPNFQKGIKAAGRVIVLLGRQSKITDPAEPAVKHFNGTGEASLQGIQFRYPTRPLVRVLKDLNLEIQRGKTVALVGASGCGKSTVIQLLERYYDPEDGIVAQDGVPLPKLNLVDARRAIGFVQQEPILFDRTIGENIAYGNNEARVSNDEVIEAAQQANIHNFITSLPLGYDTNIGSKGTQLSGGQKQRVAIARALIRRPKMLLLDEATSALDTESEKVVQEALDKAKAGRTCVMIAHRLSTVRDADVICVIHEGQVAEMGTHNELLELKGLYYNLNRRGYA

SEQ ID NO: 307 - protein, 1305 aa, Spodoptera frugiperda
MGFRKKKSESRPENELDISFIGIFRYGTFLENTATFLGIFISMISGGGIAYNLIQVGELSTAFVERTSFQDQPSSNMPLLSIFGGGKRLNNASHEENMEALLQDATAMLIGAFVSVGISLLCCTVSVALISWSALRQITTIRMRFLEAVLRQDMAWFDTDNEFNLASKMSENLMKLKEGMSEKLAVVGNLLGTSVISIAVAIPLGWELALACITVMPFSVAASVYLTNYQTKSSARELESYSQAGKHAEEILKSIKTVVAFGGEEKEVRKYRTLLEPAEKYGRKRGIYTGVGNGFNWVLTYCLNAIGLVYGIRLVLEDRDKSEEERRYVVGVVFSVLFNVYMATQSITLCVPHFEVFAAARGAAATVYYLLEREPAIDSLSTQGLSPRRVVGNISFEDIHFNYPSRPDVKVLKGFSLHIKAGECVALVGSSGCGKSTILQLLQRLYDPQSGSVKLDGKELRNLNLGWLRSSLGVVGQEPVLFHGTIFENIAIACPEATLPEVQRVAAMAYAHEFITNLPKGYDTVIGERGASLSGGQKQRIAIARSLLREPAVLLLDEATSALDPHSERKVQAALDRASAGRTTIMVSHRLSTILNANRIICMDQGVIVEQGTHEELMKSKGFYYKLVTTNKQKGEPEEATESLPELLEEDNESAVNSPVVRSETKKNRPRMSKQNSVIESFEWMQTPRGSVTSAVSLGYQSFLHNQDIDKDNSDDEEIVPLSSWDILKLNAPEWVYITIGSVAAFLQGACFPAFALLFGFTSGIFVLTNRDELISLGDMYAGLFVVVAAIAGVSMCLQSSTYTTAGLKMTTRLRELYFNALLSQEIGYYDREANTVGALCARLSGDAAEVQGATGLRIGLILQGVSSVVLGVLMGLSFDWQLTLVATAFLPIMIGSIWLEGMMSRKSQEDERDAMESATGVATEAIVSIKTVQSLGIEPVFLDKFQESLTAACRAVAQKSRWRGVVLGIGIYAPLIAFCCAIMYGAYLVSKGQLEYKIVLLVTESVMFGAYMLGQTLVYAPSFHAAKVSAARIIGLIQRQPLVRTEDGVTDKKDWSATGNFSLKEVEFSYPTRKHHKVLKGIDLHVDAGKTVALVGPSGCGKSTVLQLLQRFYDPDSGRIELDGLDNRSSLTLPRLRRQLGVVQQEPVLFDRTLAENIAYGDNTRKVTMHEIIEAAKAANIHTFISSLPKGYDTNLGSGGAQLSGGQKQRVCIARALIRAPRLLLLDEATSALDANSERVVSEALEKAAEGRTCVTIAHRLTTIKDADIICVLDKGKIVERGNHADLLKLKGHYWRMCRGQEAP

SEQ ID NO: 308 - protein, 1516 aa, Spodoptera frugiperda
MSYNSTLDSFCGSEFWNSNLTWYTDSPELTPCFQKTVLVWTPCLYLWVAAFLDTYYILNSKERNIPWNILNISKLFITCLLIVLKFVDLGVTVHTSSQEDMAVFSADYYSPIIKILTFGLSATLLYYNRKYGMRASGVLFFFWLLLILAGLPQLQSQIKAHANIPDDENVKYNFVSYMVYFPLIVIMFILNCFADLPPKDSPYKYEKNQCPENASGFPSRLTFSWFDPLALTGFRRSLTEEDLWALNPQDSSTEVVPKFDKFWEKSLRKREISNATKASYRKTSASVNFKPESEKKPASILPALCLAFGGQFLFGAMLKLFNDVLMFISPQLLKLLIGFVQGKEPIWKGYVYAVALLACATVQTMLLAHYFTRMYLVGMRIRTALTSAIYRKSLRMSNAARKESTVGEIVNLMSVDAQRFVELTAYLNMIWSAPLQIALALYFLWGILGPSVLAGLAVMIILIPVNGLIANRVKTLQIRLMKYKDERVKLMNEVLNGIKVLKMYAWEPSFEDQILKIRNKEMNVLKQTAYLNSATSFIWSCAPFLVTFLTFFTFLITDPENNVLTAENIFVSMSLFYTMHLPLGLLPLIVVSAIETSVGIKRLNKFMNCDELDITSVEHDPKDPNPISIENGHFTWGDQDSEPSLKNINLHVPRGSMVAIVGAVGSGKSSLLSALLGEMNKISGRVNTTGSIAYVPQQAWIQNATLQDNILFGKPLDKQKYNNVIDMCALKPDFEVLPGGDQTEIGEKGINLSGGQKQRVSLARAVYCDADNYFLDDPLSAVDSHVGKHIFDKVLGPNGLLKNKTRVWVTHNVSYLAQTDLVVVLRDGEVSEAGSYQQLLEKKGAFAEFLLHHLSDAERTSPEELDEIKQDLESKLGTEFQNKLQRARSLSESASESEQAAGDRAGSVKRKTPEATPNELKEKNKLIEAEKAETGSVKWGVYKHYLMSVGVLSSVITVLMNLILQVFQVGSNYWLTEWANDDKMLVNGTVDTKRRDMYLGVYGGLGIGQVVSVSVSSLALYLGTLAAARALHAALLAGVLRAPSIGFFDCTPVGRVLNRFSKDVDVLDNVLPMTLRGWTSCFFAVLGTLFVISFSTPIFMAVILPIGFIYYVIQRFYVATSRQLKRLESVSRSPIYSHFGESITGASTIRAYGVSERFVEESERGVDHNQSCYYPSCIANRWLAVRLEMIGNLIIFFSAMFAVLNRDTISAGLVGLSVSYALQITQTLNWLVRMTSEVETNIVAVERIKEYAETEQEAAWTVANGPPAEWPATGALQLERLTLAYRAGAEPALRDVTCAVAPRDKLGIVGRTGAGKSTLTLGLFRIVEAVGGRILIDGLDIAAMGLHQLRSRITIIPQDPVLFSGTLRMNLDPFETFSDEDIWRALEYAHLKPFVQGLPAGLRHEVSEGGENLSVGQRQLVCLARALLRKTPLLVLDEATAAVDLETDELIQKTIRSEFASCTVLTIAHRLNTIMDSTKVMVLDKGQLVEYAPPEQLLQDKNSIFYSMAKDAGLVN

SEQ ID NO: 309 - protein, 1346 aa, Spodoptera frugiperda; identical to SEQ ID NO: 183

SEQ ID NO: 310 - protein, 1369 aa, Spodoptera frugiperda
MESKVVLTEKNPHEKANVISKLFLTWSFSLFKKGYKQGLSISDLWQARSGDASGRLGDRLEEAWKIEQEEAKKKGAKPSFSKAIVRTFWFEYMMIGLVVGVLFMVVWPLIPFTLALFIEYFSKEKTPESYRQAHIYNFLMNLFSTLSALMLNHTNLAQGRIGMRIRIACCSLIYRKILKLNRAGLNNTEAGQVINLMSNDVNRFDLVTLFLNFIWITPIVVPVVCYLVWQHVGIATLAALAVVGVQTVIVQVYLSHLQGKLRGKIAKRTDQRVKVMSELVDGVQVIKMYAWEEPFEKLVHKLRKMEVGYVLRTSFVKGFTTALAVFTERFILFSAVATFVLIGGNIRAQITFSLVQYFNLMQMICNIFLPMGLAYLAETKVSIKRLEEFLLLEENEPEKITANMILDSKSLLSDGTEKEKKVQEKQRVTGLTISNVSASWTNDSVVDTLRNITINAAPGEFVGVAGGVGSGKSSLLQLILGELMPKSGTVNLGGAKVSYASQEPWLFVATVRENILFGLPYDRIRYKKVVRACALLRDFELLPHGDSTLVGERGISLSGGQRARIGLARACYRKADIYLLDDPLSAVDTHVGKHMVTECVMGLLEKSTRILVTHQLHHLKGADKVVILRHGEVEIQGSFDEVSRTPLFAELLQDEEEEEAAGEHVKMQRSISVRSQASSISPAEGIIGEDLIEQQVEIEEITGTGRVPGKVYSKYFSIGAGCCLLSSTVIAILFAQVITSVSDLWLTHWMNNVEAQYVANVPLFRVANDTIIPLNDTLVNATESAVTEGTITSTIGAITTAFLSNDTMETTEAILNATVFDTTIVAPAKINDRYYIYIWAAAIVGCIIATSGRAMMFLWVCMRSSIKLHNEMFRNILSATMRFFDTNPSGRILNRFSKDMGVVDEILPRMYLDTIQVFMVMMGILVMVAIVNPYMLMTTAVCAIVMYGLTVVYLSTAQAIKRVEGVSRSPVFSHVTATMSGLGTVRACEAQEMLKVQFDDKQDVHTAAWYLTLVTNTAFAIWLSLCCSAYVIVVAYTFLFLDDGNTKSGNVGLAISQGLILVNMVQYGVKQATEVISQMTSVERVMQFTSLPQEKTEGPKPPANWPQKARVVFKDLTLRYDKDADPVLKRLNVTIESGWKVGVVGRTGAGKSSLISALFRLAPIEGNVYIDDVETGKIALKELRSKIAIIPQEPVLFSASLRYNMDPFDKYSDIQIWEALEQVELKSSITSLSSPVASGGSNFSAGQRQLLCLARAALARNKLLVLDEATANVDPTTDAMIQKSIRRHFADCTVITVAHRLHTVADSDRVVVMEAGQIIECGHPHELLQDEEGPFTKMVKQLGSASEQSLRELASKAYSEHNIKNAMKA

SEQ ID NO: 311 - protein, 1361 aa, Spodoptera frugiperda
MDSKVVLKEKNPHDKANFISKIFLTWSFSLFRRGFKHGLTVEDLWQARAGDHSGRLGDRLEQAWQEELDNAKRKGIKPSFSKAIVRSFWLEYLMCGLVVGLLFIFFWPLIPYTLALFINYFSEDKTPESYRNAHIYNFLMNFLSILTALMLNHLQLSQGRVGMRVRIASCSLLYRKILKLDRTGLNKTEPGQVINLMSNDVNRFDLVALFLNYLWVMPIVVPVVSYLVWQHVGWATLAALVVIFVQTVLVQAYLSNRQGVLRGKIAKRTDERVKVMSELVNGVQVIKMYAWEKPFERLVDKLRKMEVSFIMRTSMIKGFSTALSVFTERFILFSAVVAFVVMGGDIRAEITFSLVQYFNLLQLACNIFFPLALAFLAETKVSVRRLEEFLLLDELTPAKLPLAIDSKEIISNGTEKEKPKHTGLILNGLSASWQPEAIVNTLRNITLTAEPGEFVGIAGLVGSGKSTLLQVILGELPPTQGTISLGGARVSYASQEPWLFVATVRQNILFGLPYDRIRYKKVVSACALLRDFEQLPAGDSTLVGERGISLSGGQRARIGLARACYRQADIYLLDDPLSAVDTHVGKHLVSECVMGLLRHSTRILVTHQLHHLKSADKVVILHNGEIETTGSFDDVSRSPLFAELLQEEEQPEDPKVQYLRQRTLSIQSHTSTNTLQDGAVADEVEQEESAELMGTGRVPGAVYRQYFRAGAGWGLILWTTFSILLAQVVTSISDLWLTQWMNVVEIRHGLENNQTTTPLFHNITNGNNSIGSNDTISNFTTELPTTIPSSTELPNMTVIDTMVKTVLTMQNITSVYEPINHDYYIYIWAIAILGCIILTTGRSILFLWVCMRSSIKLHNQMFSNILAATMRFFDTNPSGRILNRFSKDMGVVDEILPRMYLDSIQIFMVMMGILVMVAIVNPYMLLTTGVCGILMYIWTVIFLSTAQAIKRVEGTTRSPVFSHVSATMAGLNTVRACQAQDMLRDQFDDKQDVHTAAWYLTIVTNTAFSIWLSLICATYVVVVAYTFLLLDDGTTKSGNVGLAISQGLILVNMVQYGVKQATEVISQMTSVERVVQFTSLPREVTDGPAPPTGWPQRARLVFKDLSLRYDKDADPVLKKLNIVIESGWKVGVVGRTGAGKSSLISALFRLAPIEGNVFIDDVDTGNIALKELRSKISIIPQEPVLFSASLRYNMDPFDKYSDADIWTALEQVELKRSVTSLSSAVQSGGSNFSAGQRQLLCLARAALGRNKLLVLDEATANVDPNTDALIQKSIRTHFADCTVITVAHRLHTVADSDRVVVMEAGEIVECGHPHELLQKPEGHFTRMVQQLGPAAEQSLRDLAAAAHAEHIKYVDTDDNNQ

SEQ ID NO: 312 - protein, 687 aa, Spodoptera frugiperda
MTAGNEEHEPLITSSVDNQRVAFNNSPTGGPTPESTPRGSGGEITLAIPAHRNYGAIGGIEKVTYTWADINAFATESRSRSRRIWNFWKPSASGMFQQRKQLLRNVNGAAYPGELLAIMGSSGAGKTTLLNTLTFRTPSGVLSSGTRALNGQPATPEALAALSAYVQQQDLFIGTLTVKEHLIFQAMVRMDRHIPYAQRMRRVQEVISELALTKCQNTVIGIPGRLKGISGGEMKRLSFASEVLTDPPLMFCDEPTSGLDSFMAQNVLQVLKGLAQKGKTVVCTIHQPSSELYAMFDKLLIMADGKVAFLGSPDQANDFFKELGAACPPNYNPADHFIQLLAGVPGREETTRTTIDTVCTAFARSEVGCKIAAEAENALYFERKISSGWADPAWSEATAIRARRSPYKASWCAQFRAVLWRSWLSVTKEPMLIKVRFLQTIMVSILIGVIYFGQHLDQDGVMNINGAIFMFLTNMTFQNIFAVINVFCSELPIFIREHHSGMYRADVYFLSKTLAEAPVFATIPLVFTTIAYYMIGLNPEPKRFFIASGLAALITNVATSFGYLISCASNSVSMAASVGPPIIIPFMLFGGFFLNTGSVPPYLGWISYLSWFHYGNEALLVNQWSGVETIACTRENFTCPASGQVVLDTLSFSEDDFTMDVINMVLLFIGFRFLAYLALLYRARRAK

SEQ ID NO: 313 - protein, 1338 aa, Helicoverpa zea; identical to SEQ ID NO: 194

SEQ ID NO: 314 - protein, 1369 aa, Helicoverpa zea
MGTKKDAKNGTGEKIPPPPPPPKQKDVPNTFLRTLFCWMLPIFYFGNRRDLEQHDLPPPKNMYNSKVVGDRLERNWLNEEREAKSEGRKPKFVRVLVRTFFWSFIPGGLMQFTSIALRTASPLLFSQLLQYWSVDSTMARETAMYYALGMILANWLSSFMNHHGALYCQQFGMKIRCAVGSLMFRKIMRMSNGSLGETTAGKVVNLLSNDLQRFDLAMMFLHYVWIIPLQVAAVIYLGYLQVGTAAFIGIAALILIVLPFQGGMGQYLGKLRLRTAEKTDNRIKIMSEVINGIQVIKMYGWEIPFQNVVGQKRADELKEVKRATIVRTVFLGFMMFTERTALFLTVLTYVLLGNVMSANVFYPLQQFMNAAQVNVTLILPLVLSFTAELLVSLGRVEKFLALQDRPDLTGQSEEVSSNLFRNMSAKDNLDNLEMNGSVRPLSYHRKSDGAPIGPTLGAELKKSPNPKFARSVSYQDDTALVVHDVSASWTGDPNALALKNISMRLRKGKLCGIIGAVGSGKSSILQLLLKELPSATGSVSIYGKISYACQEAWLFPSTVRENILFGLPYEPEKYKKVCRVCALEKDFKQFPYSDQTLVGERGVSLSGGQRARINLARAVYREADIYLLDDPLSAVDANVGRQLFEGCINGYLRGRTRILVTHQIHFLKAADYIVVLNEGRIENMGTFEELVNSGKEFSMMLSQLQEGKEKDSDSLGSRSIEEKDRPALKTMASVTEEDDGEEFEAQKMEEEERQSGNLRWEVIAAYFKAGGNACFILFALSMIVLSTTSAASVDYWVSYWTNQMAVYEESLGGADIDPGLDVQVGIFTIAQYLIIHGALVAMCIAIINLRVFPFAYLCVNASSNLHNTMFSTMLKGIMRFFDTSSSGRILNRFTKDMGALDEILPRTLLDVLQIYGTLTAILVLNAIALYWTLLPSAVLLILFIFMVRIYLKAAQGIKRLEGTAKSPMFGTVTSSLSGISTIRSANAQKWLIEQFDTNQDLHTTSWNSYLNGGTTFGFYLDTMCLIYMTTVIGVFLFVDFGDTIPVGSVGLAVTQSNMLTIMLQHGARMLVEFLAQLTSVERILQYTRIDTEPNLFQGKIEMPSSWPSQGKIVFQNVYLRYAPNEQPVLKNLNLVIESGHKVGIVGRTGAGKSSLISALFRFAYIDGLISIDGLDTSLVSRQGLRSKISIIPQEPILFSATIRYNLDPFDMYSDDDLWRALEQVDLKSAIPSLDFNVTEGGSNFSVGQRQLMCLARAVLRSNQILIMDEATANVDPQTDSFIQETIRRQFVSCTVLTIAHRLNTIMDSDKVLVVSSGEIAEYDHPYVLLSDPDSHFSAMVRETGEKNSANLFRIAKDCYFQSNLKENAR

SEQ ID NO: 315 - DNA, 23 bp, Spodoptera frugiperda
ggaagaacttcctgcagcaatgg

SEQ ID NO: 316 - DNA, 23 bp, Spodoptera frugiperda
gaactgggagtagaatttcgagg

SEQ ID NO: 317 - DNA, 23 bp, Spodoptera frugiperda
gacttcgaaaatcgaggaccagg

SEQ ID NO: 318 - DNA, 23 bp, Spodoptera frugiperda
gagttgatatcgaggtccacagg

SEQ ID NO: 319 - DNA, 23 bp, Spodoptera frugiperda
gcgggtgaggatacctctgcagg

SEQ ID NO: 320 - DNA, 23 bp, Spodoptera frugiperda
gcagtggggcgacttcatgtcgg

SEQ ID NO: 321 - DNA, 23 bp, Spodoptera frugiperda
ggcgacttcatgtcggcaccagg

SEQ ID NO: 322 - DNA, 23 bp, Spodoptera frugiperda
ggtacttcccgttccagttgcgg

SEQ ID NO: 323 - DNA, 23 bp, Spodoptera frugiperda
gttgcggacataagccgatatgg

SEQ ID NO: 324 - DNA, 23 bp, Spodoptera frugiperda
gaattctttgccaggttgaaagg

SEQ ID NO: 325 - DNA, 23 bp, Spodoptera frugiperda
gaagttcccaaagagctcgtcgg

SEQ ID NO: 326 - DNA, 23 bp, Spodoptera frugiperda
gtgaacccacacactgcaggcgg

SEQ ID NO: 327 - DNA, 23 bp, Spodoptera frugiperda
gatgttcacggcctcagacgtgg

SEQ ID NO: 328 - DNA, 23 bp, Spodoptera frugiperda; sgRNA target sequence w/ PAM site
gacgatggatccagtggtgatgg

SEQ ID NO: 329 - DNA, 23 bp, Spodoptera frugiperda
ggaggctacttatagagaccagg

SEQ ID NO: 330 - DNA, 23 bp, Spodoptera frugiperda
gtgcaaccagcagtgctgtgggg

SEQ ID NO: 331 - DNA, 23 bp, Spodoptera frugiperda
gcgttcaatggacctgctgttgg

SEQ ID NO: 332 - DNA, 23 bp, Spodoptera frugiperda
gttcagctgaggagaagacaggg

SEQ ID NO: 333 - DNA, 23 bp, Spodoptera frugiperda
gcctaaccttcagtgcaccatgg

SEQ ID NO: 334 - DNA, 23 bp, Spodoptera frugiperda
gtcaagtatcgcgatacgcccgg

SEQ ID NO: 335 - RNA, 100 nt, Spodoptera frugiperda
ggaagaacuuccugcagcaaguuuuagagcuagaaauagcaaguuaaaauaaggcuaguccguuaucaacuugaaaaaguggcaccgagucggugcuuuu

SEQ ID NO: 336 - RNA, 100 nt, Spodoptera frugiperda
gccuaaccuucagugcaccaguuuuagagcuagaaauagcaaguuaaaauaaggcuaguccguuaucaacuugaaaaaguggcaccgagucggugcuuuu

SEQ ID NO: 337 - DNA, 31824 bp, Spodoptera frugiperda;
tgttgcttacagctttatgaatggtatctcttggtaatccacatccacagcctataagtggcaactgctgaccaaagtagtattctgtgaccaaaagcctcttttcgcatggagagggttgagcattaaagcattaaacaccacgcttgctcaattataatccaggtttccttaggatggtttccttcaccgtttgccagtgtcgtctaaaagtcacattgccgttagtagattttgaacccgcgccctaatgtatgagaagtaggcgttttgagctttgaactgttggtagacttttctttcttttaatgatgtaacacaaaacatagaaattgtacctattgtaactataatcaacgatataattacaactataatcaacgatttaactatccgatacctacagcacatcattcattgatacccagtcactacttaaggattacgtgcctgatgagacaaattgtgataacacattaaattgtgtgtacaaatatgatgcaatattagatatttattcgtccactatccacgtaacacaattacctaattaaattttaattgaaacagcttattcgtaaggaaatatagacgtgtgagactgaacacatcttttcagcggtgaaaatcatcctattctttctcccgctttgggtgaggcgaaagagtctcagactcttactgacttaaaaccaccccgttcctactactatctacttcgacctggagtccaataacccgttagccggacactggaatggttttagttagtaaagtaaagagtatgactgacactccccttcaacttttacaagcaaagaagctcactagctcgaaaaaatcgggaataacacccaaaacttcgatcatagaaattgagaatcagtaacagtagagcttagtatcaaaatctagaggactaatttagtagatacttcaactgaacagtaagtacctaacctaatgcagaacacaaatacatatctgaagaaatatttccaaagaattgagtctttacattcaagacagctgtcccattatccatttatgtacaaagaccacaatttcagccctatttaaatccttttttatcgtcgacatcattcagcatagaatttgcacatctagccatcataaatgctcattcgttgagagcgcgtgcgccgacgggagatctctatatgtggtcgcgaccaccgcggcgcgagtcaccgcgcgccgtcaatgatccttcacaactatgcgcgtacgcagctgtcatagctgtatgactcaatgattgttattagctgtaataataataaatcttacaacttcgttacactttgtactggaccttttttgttgattgtttgtgggcctgtggtacaattatatttattgcctggattggacaccaacatcggatacaaagagattttgcatagtttttttaaacaatacaacgaaattatgcatagttttctgtcttactaaatgcataaatgacaaaagcctatcaagccagatggaaataacaagcatattttttttttaatatgaagctttgaagttcttttataaaattttaagataaatgaattagcaatctcagcacaaattttcgacatggattggttcccctaacgcagttttataactgaaataagatttgaagaacagtggatttgtcacccaggtacatatttaaaagtaaaaaaaaaatataattacaaaactaagcacaactaatcacaataaaccaaattgtaattcactattcctctttaaagacataaaagttgggcttatcttttagatcagaagtaaattccttaaaagataataaaacaattaacctagttagtttcaattcaatactggatttaagttgcttcctaattgcacaatcattcagtctttataagtcctagatacagctagttttcaccttctataaactagtcaccagtgaattgtactaatttttttaaacatgtggttaaataaataaaatacctaagtagtatatatctcacctcgtgaactaggtagaaacctgtatctaaggaaataaattacttttatctttactataatagttattgctgtatcattttatgatcaagaatcaattgattgtattgctcaaaaagtgtacttacactcaatattaggatctaccaatatacttagaataagaaaactctagagattattcattttaaattctgaactaaattaaattacaaacagtctttgtactgcttttataaaaaaataattgtattatacaatgtactgtattatacaacagtattgaagactgttggctaggtgccctgtttcctagatgtcaatcatattacgtaagtaatataatacttatacaatttatgataggtgtttccaggacaagtaaagattaccatagtccctataataaaataacttaaactcctccggttttcatcacatgctcgatcaatgtgtcaatagtatagtattatacagtgtaaggaaacaagacttaaatttaaaattgttaaatacttgttctaggtaaacttcatcatcattgtagtcagccttgaagtgttcgctgcaaagcaaactgtattttacatggagaaggttttgaaaattattcaccatgcttgctcaaggtggattagcaatttcaaacttattatttggaattataagaacaggtttgcaaacaatgtttaagtaatcgctttcttgatttataaaaatagcaagagctagaaaaaaaataatgtagatcatgtaagtaactctatttgtgtaatagtaaactctatttcttattatatatttttatgttagagttacctacaccactcagtttcttttttgactatcatgagttctggtttttcttagatgtgcacatctagccaatcatcccccaataggatgatacttggtcatctccagattgataggtacgttaaattatgtttttatcaattcatttacgtagttacttgagtactacctacttaatatttgacacagagatttcattaatttactctgaactgagaagtagagctacactttagtcaagttgtaaaaacaaatatcaaacctatttatggtcaataaattaatgtaatttaccacattgtttttataatttttaattattcatttttatccttccggaatcttgaacattaaacttttttccaacataatcaaacaaattaacaacacaaacttcaaatttcgaggttcattgaactttagaggtgtagcaaaccgtatgtattcggtactgagtaacgggtgcgccctctggtaccgagtaacgaaacgttactctcgaatgtatttcgttattcgcacgatctcgttcctcgtgtttaaccgaaactgtgttactaagcatgaggcttaggaatcgatattataattagggatgcagtttaaaaatagtttttgatttgtgtaacattgtttttatttaatatgtttaatttcattttaagaacaaaagatatttgtagtttaaaatacatttttatttaatatatctaatttcattttacgaacaaaatattgttgttgtttaaaatatattttcatttaatataaaagatttttgttgtaaaatgtttttgtcaataaataagttagacacatttgttgctttttcattataatttagattccgtgaatttcaaaagttcatttgcagttactatacgggtaccaaacgatacgatatacgaatggattcgtttcgttgggtaatactgatgtaccaaaagtaacgagtaacgtaacgatacgatagtaacgagtactcatttttatagtaacgaatacatacgggtttgctttttctcgttactttcacacctctattgaacttaaccttatgaagttatcagttcaatgttcagtttcattcattccaaattgggttgcccattattttattatccgtgtatataaaaaaaaatatgaataattgtgaaataaaagtaaaatttaattttggtcactaaaagacgcatcaaattttaatcaagtactatttattcaaagtaaaggtcattaatagaaagagagttttcatttgcaaaaatattttcttgacatttatataggggtggcaaccctacgaatcttggcctttgacattggcttaggccttctcccgcctcttcaatggttccgtgagtcatttcattgtctattatattaaattaattaccattatgatgtagttacataaaaaatactctgctcattatttaaaaataaataacttttatataattaattatgttgacacttgatagcgttacgtaggtacttacttacattctatgaaattcaaacttttacaaaacaaaaaatctaactctttgaactaggtactcagcacaagtaccaattacctaaaagttaatttaagtaatttaaataaagttcatttgattgtaaatttaggtaggtactctattattgctagatagtagataagaccggcaaacagatgaccgaggtatgacgtcacaaatgatattcaccctacagagggaggattatgacgtcagagggtttaaatatgcgcatcttaggaaattgggagtatttgtctcagatttgggagtacttagtatgacgacgacgtgctaacaatgtcgcgtattcaaggtcagataacgacatgtgaatttaactaaaaaccacgtagacgtaaaaatatagacaaataacatgaagacacacaaaaatgtacctactaggttggtaactacatatttacttactttattatttatgtagacctgaatcggactagtaaaatagatagagttcaacgacttactgttaaaagttaaaataaatactcacctaatattaagtaaatatcgcattgtatttcctcctgggtatcgcagtatacgaagttacataatgaatgatttgtcgtatttggtgctactatggacgtctacttactaacatggttccatacagatacattcaaaccaatcccatacaggccatacaatttgatgagcacaatcattttgcgagtatattgttagttagtttaatgatttgcgaggagtggccgttgctcagtggctcgtgcagtgaatttagtcaaaatgtttcagccgcgggttatgttaacgttcatggaggttccaaggaaaagaaccatggtggaaaccgggagccttgaggaaaggttccggttaataccaaccagcactaataccactccaaacaaggtaagagtaaatttgaatgtgtgtgagtgacgcgcgaaattgaatgttttaagtcgtaactttgtccttacattactgtaacagtttattgccttacaaaaatagctactgtttaaaaacttacgtactaattcattacaaagaataaaagaaaaagattttacaagtaataaattatgatacaatagataatgttttcattgggccatgggacaaataataaagcaatctattcaatcaataaccggaatttaaaggaaatgtgtcactcaaacattagttacgcccaactaaaatgtaacagggcattgtcaaaattgtcgtggaagtgaaaaaaagggctggacaatgtacgaattctaaggaatgatgcacccaacgtgttgtttacaaacagactgagcgaaataatagtgcagtgaaacttgtggcccaccgtgaccgaaactgacgagaatagcggtccgccataaatcactggcataatgaacattgtcattgctcactcttcgtttttatacaagataatttaaatttggaataataaaggtattggtgacatttttcagaattttcttggaagtttgatgacgcagaattttttttttttgttataggttgttgacttgtatattcttgttgtacttacctaggttccgttaactttattacaattacattgtgcatattttactaaacaattggagttatcccttcaaacattagctaaagtaaacaaatagtttcaagtccttgtgaacacagtctcaaaaaagtacttgcctatttgcatttctttctcgattgtttattttcgttaccaagcaaattttgctaaacggggaccccgtagaccccacaaacgtttgccctagaatatattttaatagacttacttgccttgctagacataccttagtagacttagtactactagactaggcgcaatatctggtttaccgactgctgcgcagtgtgtcgtgggttcgattcctacacgcaataactcatatgcgatgcactgcacacttttgggtttgatgtgtatgtgaatttttatgtttgtaaacacttccatgacacagacgaagaagtatcttagtgtgggaccacgcttaaaaaaatatttcacgattccctagaagtaggtaagtaaactacacacacatacatatgtgtaggtacctacgtaggtacatagtcttgaaaagataaaaaaattacttatgtaggcatcagtcattcctacttctgctactattcctaccaagaagtcataacttaccattcatgcttcaccctatttctcgctcactaccagccatggataagctcgcaacctaaagccagctgtttacgcaataatcgataaaattacggtgcggtcaaccgtcaccgtacactcgtggacgacaaggactatctttatagcttttatgatattcctgaaacatctcctcgaaaaaaaaatttatagaaattacttctagaatattgttaaaagccattatgataaaagttacaattactacctacaataataaaaacgtaatcttgatcaatcgtagtcgtatgattaggaaataatcgtacgtcgccgtcgtatcgtagcaacgatgacaaaaaataaatacaaacatttgtcaattaaaaaatataatatacatttgtagtgttttgtttcgagtgtgcttttgttgtcaacaagttaattattgatagctagtatttatttgtggtagattctgatccacatacgatttgatacacagttactgaacccttaattcattgtgccccatgaaaattttacatacagtctaaccctggctgttgaaaatcgagctttcatactacatacatagagacaatagctatgtatcagcgtaaacggcacgatacacatataggaacaactcacagttacctgtgtgactcacgagtgcaaagcaaagatcattaagacccgccagagctgcgtaaaacaaacaaactttcgcgttatttcgcgccgactttcaaactatttgtagcttttcacgcttcaagggaacttgtcggccattgacgcacttacactgttctaaaccaaacgttgtattataatcgagtttcagttctacagcacctttcacgttttatcgacctgataaattgataacgtatcatggatgcgttagtcgcgattgggaggaccgcggataaacgtttcagccgatatatacggctgacttaattcatagtgaattagtataatgagtttttaaacacagtagctgtctgtagttgtggtgtggcctgttgttgtgtgaataattcagttaattaattgttcaaaatgaaggactcgaagggaaacgcgtggcaattgaaaccgggggaaaaggagaacgagaataaattaccagacccattaaatgaagatgtacagaaagggcaattctctgacacgtaagtttaccttgtatattacatattattatttgtacgcatgtaaacaatctgttgattgtcgaacaatagccaacaagtaaatattttcttagtgcaatcagtggaaacggaaccctagaactcctagaagcgaatgacactgagcgcgaattgtttcaattgatcaacaaatctattatcaacaatacagacgcacaccagttgtaacattatgtatactatactacatttatattctccgcgcaattgcaattaaatattatgaaacattgctactaattcgccgagactgattaaatatgatctcatcacgagactggcccgcactggcttgcctcagctattccttaaccatgggttaaaaataaaacaaactatttttatgaaacgtccagattgcggcgctagtttcctactgatcgccaaagtacaaatccatcaatagtatctgtatgacgtgtaatggcaaggttacatgtagttgtaggtatatttttttataacaaaagtcgagataaaattccgtataagtacataatttttatgttttacgtggttttatcgaaatagaattataatcgtagataagtgatatttagttttgatagtattgttattatttttattgtgcaaactattcgtgttgcgccaaccactcttacagggaatgtttagtttcagtactctagaacataatattaatacttattgatgctaaattagacgaatactcaaacagctagtttcactgtacggtaacacaatcgattttgattccctgtagccttgatcctgaccttggttgcggcaaacacggcaaacaccacgtgggatacatttcataaacacaggcgactcgtactcgcaaacaaaactaaaatagaccatatccgcatacctacctaaaatatgttcaggacgcttttgaattacgctagttgtcctgaaaaaaggactaaagatatatacgggtatcttgcacaccattgtgcacgtgttttgtcataccatgaatttgaatcaatttagaaatataggtataagtagacttttgtgttccaaaattaatcgcctttaataggtttatagctataatttgtttatcatttcattacaacagacagttttgtttaatctattacctacctactagctttcctacatccctattatattttttacgtacaaagttcatttgactatattttttgatgatagaggtaatttaaaatctgtttatgagatcaatcgacttgtatttgctaaaatttagctacgttttatacttcggaccactgccacctggccactattgttacgcatttaccttaaacttaatagttaatacgctttacatatgtcttttaattgtattgtatttattacaggagttcagaaccatctgaagccaaggctgaggaagtaccaagcataccttttattacactagtgagtattttaatttaaatgacagatagttaagataaagtacagtaaaattctaagttaaacgaaagcgattacgcgtaactaactgccatatttagagacatttaatgattacttaaactattccttaataacaattttgttccgaaaacaatcgctaaggactggatcaagtaggaaatctacatattattaaaatgagacattaattaatgaactgttaagacgtttgtaaagttgcatgcaaattgcatactcaatcgcactctaagttggcacgtagagtgccagactttcaataccctttattatctgcatatcgagtaccggtacggtatgtagatagattgcggacattcattatttaaaacgtattaaaaaaatcttactacattctacatatcttttgtagaaaatatctgtaaatattagggtgaaatgttacctactattttaggtatattttcatctatttccgtgtttgtagacggtaaagccacagaatatcacagtataagcaaaccgtatcgatcgggcggagtagtgtaacgacgtctaattaacttgctacccatgactgttgctgacgttagtaaactacattggaaatggaatgtccatgtagccattacaccttatcagctgaacatagacgtgtgtagaaaacaaatacccttatttgagttgaaaataaaagcgaaattagattgtttgacatgtagattagaaaattttgtacgttgggtcgtgttattttattgagtttattaatttatttaaaaaaaaaaaacagtgtaaagacgctatactaatgagtatcctataggtttcgttaaggccccggccccattggtccgttgcgctgcgttgcgtcgcgacgacgtaaaggtgtaatgggccttgtcataaaaaatatatggaaaataagacttcgacgagaggacgcgaacgcaacgcagcgcaaccgtcaagtgtggccggaacctaactgaaataaaacacaagaaaaaggcgatatctagactatacgttatcatcgtttcaatccaattttcatatgaaagttaatgataatgcaccacagaaccatcttacaaacaaccgttatttaaccaaatataaaactttcagttcagatttgcatcgacaagggacaaactcttcataatctgcgcgttaatatgttccgcggtcgccgcaatatccacgccactgaacacactgttgcttgcgtacctactcgaagctatggtcaactacagcatctttggtgatgctgatgccttcatgaagtcgttactgaacttcgccatatacaacgcggcagtcggagcggcacttgtggttctgtcttacgctgccactactttgatgaacatcgctgcttataaccaagtaggtataccaacaaagtcatatttattgtttccgtcatcatcgtcgtcatcattaatagcccgagagtctactgctggactatgggcttcctttacgtataaagaggggtttgccataatcaccatacttggcacgcaggttggagatcgcagattaaaatgattagacaatgtgacattttccgagttatatgtaggtgctttctaaaattatttaggaaggaaaacatcgtgaggaaacctaggctttataatttctaattataagcttgaaatcgccaacccgcattgagcaaatattggtgaataatactcaaaccgtctccgtgtgagaagaagtctttggttagcaatgtggccacttataagctgatgatttgtgtgatgtgtgtgctgctggttagagtccactaaccgactatatgtttaatctctattaaaaatgtatgaggaaatttatcagagaagagactcagttgttagtcgcttatgtagaggcccttttatctgcaactgatatattttgaaaagtcgataagctctaatttttttctgaactttgttatctaatcgaatattgagatattgcaaggttagcgaaccatatcttcatgtaacagttttgcatcaatgcattttgataggtaaaattatttcgtgaccaaatgtttactaagtcctttttcacctacaggtatatgtaatacgacaagagtatttgaaagcagctctaaaccaggactttggatactttgatgttcataaaaatgcagaaatagctaacaaaatgaacaggtacgatttacttaatactaaagacagaaactatgtagtttctttattaaacgaagtatattttgagtctgagggatattgtgatgtgaattgaaagatgtaatctcagaaaggttaaagaagaaaagaaattcgtttctgaatacatgaaaagagtcactatttgtagtaatttattcatttaggtattaatggtataccaacagcttctgtacaaagcgtatttagtacatttaattttgggcttatacagcaattagtaattgaaaattaattggatctttgtctcgcagtgatataatgaagctggaagagggtatcggagagaagttagcgaccttcttcttctaccaggcttcgttcttaagcagcgtgatcatggcgctggtcaaaggatggaagcttgctctgctgtgcctcatctccttcccggtcaccatgacccttgtaggcgttgctggattggtaagttctgatattgtatattttattaggtgtccataccctctgggtaaaatgggaaccctattactaaggacgtccgtccaactgtcaccaagctgtacctatctcatgaaccgtgatagccagttgacagttgaaaggaaaaatggtgataggtttatacagtgcagtgcgatgcgcgttcgagaacggtcgcgttttcgctgcactatacgaatattatattcgcgttttgcgcggcaatagccgctgcccgtctcagtcgcgatgagttctaaaccactcatcgccaacgaagttttggcattcattatccatgccatcgactacatggacgaggtcagcatcgtgcagatctgcagatcagcctacaaagaggaggaggtttgcagtgctaagctgatgctcttccagtcgctcggacaactagagcagatgccatcccgccgaagggacggtggcgacaagagcctgcaggacatcatctccctgctgaagaggactgatcctgacgacgtgcctgaattcgtggcgagggacttacataagctgcctcccgtcacgtttgatcacgtcgatgtcaccaggctgctgaaagacatgacttgtctaaaggcaagcctggaagatatgaagtccaagatggaagcgtcacaggctacgatcaatgacctgcgcggtgaagtggcgttgttgcgcaatgctacttctgtaagtgggtcaatggacatcaagaatgtgaatactcgtcgcggggcgcaaaatgcgtccgtcatcagtttcgagtcggcgaattcgagtgcgtcaccggtcgccgatgtcgctgacgatgcacgccgtcccgccgccaccgctgtgtcaacacctgcggccgaggctcgtgtaggaacatcgaccccaaatcgcgcctacgcagcagttgcagccaccaacaagcccgctgtgacgcaaacaaagcggatcaaagcgaaagggggtcaacaaactcgtggcaaaccacagccaccgactggtccgaagaaggacacgtgcgacaaggatggcttcataaaggtagaaaggagaaaaaagaagccaccttgtaggaatcagtgcggtaccgcacaaactggacccaatatcctgctgcgtcctgcagtaccaacgacgcagctgtacgtgtcccgtctacatcacaccacgacggtggagcagatcgtggagtatgtccggtccaagaccaactggaccttgagggtggagaagttggagtcgcgccacaacacgaacttcaagtcgttcatggtgcgagttccaactcatcacttcgagaccttcctcaaggaagagttttggccgaagggtgtcatctatcggagattccgaggaaggctacgcgacaccacgcagcgtaacacgacgccgacgcttcgtgtgcattagtttttaagtaatgtttatataaaatatgtattagtatataattcaattgtatgtaatatctatgtatagtatttttctatgggcctttgatgcctgaatcaaataaataaattaaaaattaaattaaattatacactatgagggcttctgaacaggtctattagaggacccggtgccacttacaggtgctgagggtggctgagggagtcaggtgaaaatcccttactccctagtcttttatccccagaaacctaggcgcctctagaagatttccgccgtcatcaaaaaaaagttttatacactaggactttctcctgtgtccagttagcattttatcacgtatagaccttcaaaagatattagatacacaattattatacaattacaataataaagaaataaaactatcatcattgtattatttgtgtcgcttagatccgcgttaaactgatagttgataccgaaagtcaataaatagatactcgaaaatgataaccgatactatacaattagatatatcagtacgtaacttcgactgtatcgaccaacccgtggagtagagacaaatattggaatttattaaaaatattggtacaattttaaaataccagcctaccccttcgggggtaagacgtgactatgctttacaattttaaaatatcttgctcaaaatatgaaaaaaaaatatcatgacttatctcagcataagaacaagtcgggctttcccgaatttattttatggtaaacggcaaacacagtggtgcacacaatattagggattatacctacatatgtattggcctatatttaaacgagatgatcctcaaatgtaagatttgagaaaattttgtaacttatttaggtactttatcgaaaaaacgatagaaaattttaactatcctttgtaaatggttccgcgtttgattcagaaacacatttggatctaaagtgcggacgaagtgaggacaaatgttcaataattacgaaaacaaactagtaaacgttactttttatgagcgtgcactccttgaggtaatgcaatgttctttaagtctcctgcggttctcacacaagttaaaatgtaatattatttatgttttctacggttcccacacatggtaacatgatgataactaagcatttcccaacagatagctgcaagtctttcaaagaaagaagctatagcgaccggtaaagcaggtgctatcgcggaggaggtgatatctgccatccggactgtgtacgccttcagtgggcaggagaaggagctcgacagatacgagggacacctcaatgatgccaggaagatcaatgttaagaagagtaagtgtttcttttaacttaaatctctttgcgactattttggcaattaccctaatctcaagaatgtgacttacaggcaaaagcacatcaagatcctctatacattgccaatacatttccaactttattacgatagagttaaggttacaaatctattaaacaattacatctggtatatcttaatgcgccggtatcttctgtagatatgactgacaaaatcttctttcaggtttgttcaacggtctggccatgggttgcctgttcttctgcatattctgcgcgtacgcactctccttctggttcggttacagactgatggtaacagatggatacgacgtttccaccatgattgctgtaagtaagctgtttatttcatactttgtaatttttttatggcattcaacattagaagtaaatgccgaccattggcttaattaacgtaataacaccatgttgattttgataccgtcaacggctttaaactaaccacacacaatacgaacagacagcgttcggcgctctgattggttggttttattcgagccggccaatcagaccaccgaacgcggtcctcgtttcgataactttatacgtattacaaactttactaagggtacagatagggcagaaacgtaatgaagtttatctacccccccaggtattcttcggtgtaatgactggttcagccaacttcggtatatcgtcgactctgatggaggtgttcggctcggcccgcggagccggcgctcacatcttcaacatgatcgacaatgtgcccaccatcaaccccctacagaaccggggcactgtgcccagtgatattgagggcaacatcgaactgaagaacgttgagttccactacccatccaggcctgatgttcctgtaagtacttgtaaaatgtttttacttttaaactctagataaaacactatgataagacctttgttcagcagacgtcttctggctgataatgattctaatgcaatttgattctaatgcattgttcacactaagttagtattttcaagtcgagtaacgagtatttagtaactccctctcgctttaattttaagacagatgcgagagagagctagtatacacccgctactcgactaactaacgttagttgagtagcgtaaagctgcttttcttttctttacagaccatagtaaaagaatcaacgtttcagcatcaattcttgtatacatatgtataatattatatattcatgtaatttgatcgtgtcgataagttacgtgcgacagacagatttaatgttttcattcacgataacacaaaaatgttttaatagcaagcaaattagtcatgcatgtgcgaagtaggtgccttacctaaaatgtaggtaattatacataccgtattgctagtctaccatacataggaaaagataacagagtatactgtaatcgtgcgaaaatttgtgataaattcgttacttttatcaacattttgttcttacaacattccagaagagttgtacggctatataagacaattaggtatatctaatgcctatttattgaaacaatataatatattatagacgataaattcttcagtccaataacgagcctaaaggaagacatgagcgaatttggaactgtttttacccgactgcgccagaacgagggttatgtttttaatcctacagttcatcaattataaatcttatcgttatttagtgagcgactagagtatttcaggatttacactttcaacattgatgtcgccgtaaagtacttttattcgttacacagcgtcatcctagggtactcttattcattacagcttaaaataataaacaaaacaattataaaatgccaataataggtacatatatatcacctaacacgtgttcatttcattcaccacgagtgtgatcagagtccaaaaattcgcaactcatgcagataattcgtcctttatttctgctataatctttgtgattcatttattaattttattggcatattatcttgggtaattaccgacatatttattgttttttgacacagacatacatacataacatacggtacctatctaaatcaaaaattcacaaaaataaatacgtagataacaagagaggacatttcacaagcatctctatgtggaaactcactaatttcctacctaatgaagatcatcatccagatatgaaatgaaattatttaatagcccgaaccaattgtccaacacacaaaaaagtatatctttttccgacccataaaatcaactagaactctagctcggccatcgcacttgatttcttaatcacttcaataataagagcctttgagcataacaaaataaaattcacatttgacacgacgcggtgcgaaaataaattcgcgcaaagacagatgcagacaggctcccttataagataattaacattagtcattaactgtaatagttacctatttcttagaacataattgtagtcctagatccgtatctgttatttgcagaaagtgtaagacttatcgttgagataacatgataacctatatgtatatggaatttgctgattatgtagttctttgatttatttctgttaattatttaattaattaaaataaatcattaaaagtgaaaggaaatcaaaggaaaaagtatttacgttccgggactggaagaaaaaataataaggcctagcttaaagctacacaacttagacaaatgtcaatgcaacacctctacgggagtcatccagtgtggaaacacacacaaatggaaccctctccatattattaagctaccatctaaacattatatagattttcaaccttattatttcagtaaaataactgaaaatcttttaaagaaacgtgacgattagagacatttaaatgtctaataaatgtaagagcctccaacccaaactaaatgatgaatcgtttgtccaggtactaaaaggtgtgagtataaaggtgaagcgcggtcagtctgtggccctggtcggccactcaggctgcggcaagtccaccatcatacaactcatctccagattctacgacgtcgtcgaaggaagtgtaagtcgcttttgcaataatttgtgtttttctgttcaatatttttgcgttaactagatgacgccactagcggaaacggcaatttttattaaacgttacacttgccaaataaaacatagttcgctgtagactatatatatctatgagatttagttgtctacttgttccatagcaaaatatcaaacgaggtagcccaattacttacagcaaaaataaaattggaagcaaaactccttctaataacttgtaaccatgacagtaattcgtgagaataaatgtagaaagtatctaatgatatctattgatattattatgtcgtcactaaatacgcgtgtactgataagctttagatgttatgtaggtaaaattagaatggctgacgcaatgacggaaggggtttcgtctaccattttgtgaataatctgatacacgtgtgtttatgaaatattagacactattataattttattaaagttgtaaactaataaactactaccactattgtatctaatcaaataaaattattgagaactaccgataccagacaatttgaccgtatatgtatagggatacttacattcttaatattccaatttacaatatcgaaatgggactcatggaatggaaatagttatttttctgtcttttaaatttcactataaagtttcgatcttctattagtaccacagtaagccaatctggcaattatattactaaacctcgatagagacttgtaactattagaaatggaacttttcaattcaaaatcttagcaatcctccaatatttctaaatccataatattaatacttaggtcgcaatcgacggtaacgatgtccgcgacctatcagtccgttggctccgcgagcagatcggcctagtaggccaggagcccgtcctattcaacactaccgtccgggagaacattcggtatggacgtgagaatgccactaatgaggagatcgaagcctgcgccagacaagctaatgcacaccagttcatcatgaaactgccgaaggtaaattctatattgtcctaggtcctatgaaaataatcagcaaaaattttaggtataagcaactgtctttctacaggacataaaccacttgtcgtacgaaaaaaagagacgttaatcaccagcacgattgtattttaatcataaattacctattcagaaattctgttgaagcccaaattatgtacgacactatctgtaaatgtctctgttaccgtataattgcaaacaaaccgatgaataggtatcagttaaagttaaatttactatggtagggttacgacacactggtgggagagcgtggagcgtcactgtcaggtggtcagaaacaacgtatcgccattgctcgagctttggtacggaacccgaagatattgctactggatgaggctacctccgccctcgacacctcttctgaagccaaagtacagaaagcacttgataaggtaatatttatgcaccttatttctagattttgtaattttttcaaacttaaatacgtactaataaattttattcagtaacaccctgatgctatcagttaacaagaatagtttaatgaaatatttgttaatattttactactcgactagtttcaaacctaactggagctcttaattaactccacattaatcgagcatgcctaatttttatgttgtgtacacaccgatattaggccaacaatacccattataacatttatgtttaatctattataaaataaatgatctatcttacaggcacaagaaggtcgcacgacaatagtggtggctcacagactgtccacaatcaggaacgtcgatgtgatatacgtgttcaaggctggtttggtggtggaatgtggcaaccacacagaactgatggccagcaagggacactactatgatatggtgatgctgcagaacctgcctggcgtggatgagcagtcgcctggtaattactaaatacactttctattatctcattcatgatgactaggtacttcatgactaattcatattcatacaaagtaatgtgtaatagtaatctattacacattactttgttgaagacctttgttgtcccttgtcgaactagaagaccaaaatctctaacttagagtaaacttgatgttgatattttacagaaaaaaccaaattgtctcgcgagacttccataatcagtgaaaaagatgacgaagacgagttcttggaattccggaatgatgtaagtattccttagttatttaaccaacatcatacgaagacgttcattgcttttagaccattgaatagacagttcttctctttaaagttctatctttagaaggtagacttatagagagagatatttggtgattggtgtgtaaaccttcttcaatcaagtaaaatgaaatcatctgcagatcaaggaaatattactgagattttcaataatagaaactctaagcagtatcacggagactataaatccccttttacatggggtacatagcataacctgtcgaaaagtgactactatattgaatatgaccacattaaacaatcaataatgttacctaatgcttctatgatataaaataaatttttgtctgtgtccaggacaaagaagaggacgcaaccgaagctcccgacatttccttcatgagagtgttgaagctgaacaagccggagtggaagtccgtcaccctggccagcatctgttctctcatgagcggcttctgcatgccactgttcgccgtcatctttggagacttccttgcggtaagatatactttgagaaagaacggggtggtttttagtcagtaagagtctgacactccctctctcctcgcccaagatgggagaaggcattggatgattttaccgctcaaaaaaaaaagatatactttactcactccttcaaccgtccgcttatttaccaatttatattaaaaaaaaaaacgcttaacagatagatgtggattgaagatcgtagtttaaaaggattacgtttatccgaggactctgctgcccggtctctgttagaaatctgcgggaagaataagggtaccaatttaaaagtttcgtgtctttttcagttactcgatggcgacgatcctgacgaaattcaaaaaggagtgtcacgattggcgttgatctttgtcggcatcggtgtgttctctggcatcactaacttcattgtggtacgttcctacacatttttataataattccccaaattagtatagcattaagtataaacatctaattaatggttggttggtcaggctaagtagatataagtaactcgtaatttcctaatgaagaagttttaattctaaagtctagtaaaaccatcactgttaaactgcacaattccaggtattcttctacggaatagcaggtgaagcgttgaccaagcggctgcggctgatgatgttcaggaagctgctggagatggacatcgggttctatgacgacaaggacaactccaccggagcactctgcgccagactgtctggagaggcagccgcggtccaaggggtaaggtcattctattgaaagatacagcttgagctgatggtaagcaatcgccaccgcccatggacacccgaaataccagcagatgcgttacaagtgcgttgccggtcatttgagggttaggaatttaagggttgtgtcgcgattccccatcgcgaattgggaagattgaggaagaagattaattgggcctccggtaacctcactcgacgtaatacaacgcatgcgttgtttcccattggtattctatgaggccgtgatatcacttcggtcgagccggcccattcgtgccgaagcatggctctcccacatttctatatccatttatgttctagtctgccgtcacgacattgctgataaaaataaatccaacattataataacctgagaatcttctaccttccaccaggctacaggtcaaagaatcggtacagtggtacaggcagttggtacattcggcttcgctctggtactgtccctgatcttcgagtggcgagtgggtctggtggcgctgaccttcgtgcccatcatcatattcgtgctgtacaaggagggccgcatgacttacgccgctacttctggcaccgtcaaggtcatggagactagttctaaggtaaacactaagattttgtataaattggggagaaacgctaacttacatttatcaaagagtttttaaagtaggtagagttatgctctcctgcttttaaataaattcttgactcgaagtttggtgcggtggttggcaaaatggctggagacgtgtagcgggttcgattcccgcactgtgcaactctttgtgtgatccgcaaattgttgtttcgagtctggatgtcatgtgtatgtgaacataattgtatgtttgtaaatgcacccacgacacaggagaaaatcctatgtggggcaacgtttttttaaagaaaaaaaaatctctacatatctaagatttccataatagcatagcaggtaggttggtgattacagttttaaaagagtcagcttagtatttatcaaaaaccactactgtctgagcactgacatcaacacaaaatggcattacagatagccgtagaagccgtggccaacgtccggacggtagcgtcgctgggtcgcgaggagacgttccgtcgcgagtactcgaagcagctccgtcctgcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtaagtcttgtagactatatgtgttgattaactaggttttattttgtttcctgtttttaattttgttgttatgtaaaaattacatttttgatttaccgctttgaaaataatgtgtcacaataggtatgtatattgttttacccagtgttttacctacaaaagataattaaaattattaacaatttttttttgtgatttatggctcactcactcacttgattgttttgtttttaacgtaactcgactactttcaagttacgcttggacctcactcgtgagcagcattgcgcgataaaccgaacaaataatcatttgactttatctctaaccctcgtataggtcagctcaagccctattgatgggtgctacgtcagcggcgcaggcgtttgccttcgctcccaacttccagaagggcatcaaggcagcaggccgtgtcattgtactactgggaagacagtccaagatcactgacccagctgaacctgctgtcaaacacttcgtaagttcatatttatctctgtttattttatttccattcgtttgttgaacggtgccaaaaaaggccatgtagacaccaggttatataaagataagtcgggttttcctttctggcgctataactccagaacgcacgaacagttttcgacgattttgcattcgttggaaaggtctcgggctccgccgggtttgctagttcccaataaaaacgtgtgaactgtaatatttttgcggttacttctacaaagtggaagctgatatgtagtctttatttattttctttatctaactgcatttgaacaactcaaccaatctttctattttcgtacagaacggtacaggagaagcaagtctgcagggcattcagttcaggtacccgacccggcctctggtgcgcgtactgaaggacctgaacctggagatacagcgcgggaagaccgtggcgctggtgggggccagcggctgcgggaagagcaccgtcatacaactgctcgagaggtactacgatcctgaagacggcattgtggtgagtcactagtttcaagtagttaggacttacttgatacggtttacgagaattccgcatgatttgctgaatgcgttcacgatacaagacgatcataatgtcaaaaacgtacctatgcttcaactactaaacgagctcacgataactagaaattctaatcccaaaaaaatttgccttgccatctcgtaaggcagttgtcccaccaacggcgagtgaacgactaactatcggctattttctcgctcaagaaacgtacaatagatatactttccgtgtaaacaaaagagatgcatatacaaatagttgatcgctgactgttcacactgccggcgagtgctcgcttcacttgtttgtttttgttttcactcgttttcactcgtttctagttctagctctactcgttactcgttcatcgttgccggtgggacaactgcctaaaacaaagtagatatataagaagtctttaaactgacatggacactagtaatatcattagaacttaaaacgggatattttaagttctaatgatattacaaagtagatatgttatgtagccttcgtattcttagcacctagactatcttccataaagactttaatcataagcatctatgacacccacaggctcaagacggcgtcccgctaccgaagctgaacctagtagacgctcgacgcgcgatcggcttcgtgcagcaagagccgatcctgttcgaccgcaccatcggcgagaacatcgcgtacgggaacaacgaggcgcgcgtctccaacgacgaggtcatcgaggcagcccagcaggccaacatacacaactttatcacgtcactgcctttggtaagtgattgattattgatatttttttattgtggactattttcaatggaggctattttgaaacacaaacttaaactgctatttcactactatattctgcctactgcctcagtaaaatatagtttagtggtcaatattagcatgtacaaggggtacctacctacctacacaaaatagaccagctttagaacagccactatgtactcttcagtttgtttagacgctgtctactttttgtgtaatctatatttcacttgaacctttttgtgcacagcggcacgagaccattatactcttctttgaaacaagaaggtgatgttctttaagatcactcagctcctagtattagattttgggctcaaattaccacatgttgttggatataactactaataactcaattgtcaacttctacagggttacgacacaaacatcggatctaaaggcacgcagctatcaggtggacagaagcagagagtggccatcgcgcgcgctctcatacggagacccaagatgttactgctggacgaagccaccagcgcactcgacactgagagcgaaaaggtatgtccaactcaagtttctttttataagataaggggtaaatgagctgagctgcagactacctagcgggcttccggggctccggctcaaaaagcaagagttaagtacgggctggttttagtcagtaagagtctgacactccctctcgcgtcactcaaggcgaaacaagtcattggatgatcccccccccttaaaaaagggggtaaataagctaacagattacgtgatggtaaccatctgcactgcccatggacatacaccagtggagttctttacaagagcgttgcaggccttcggggaataaggagtttctgtactagtgaagaagtctttgggattaggggatggagagatgattctcggtagcctcacccacgcctacagttcctctggtaaccacatgcatacaacgaaagacaacgcaagcgtctatcacaccaacttttttgtgaagccgttgttgtatctctccggtgacattgttctctacgcttaaaggcattttaagaacatactatattttatcttgcaggtggtacaagaagcattagataaagcgaaggcaggccgtacgtgtgtgatgatagctcatagactcagtacagtcagggacgctgacgtcatctgcgtcatccacgagggacaggtcgcagaaatggggacacataacgaactactcgaacttaaaggactgtactacaacttaaataggagaggatacgcttaagttatctatttataggtataggagtatttacttaatatagatggttagtcaaacagtctcacagcgcttggcaggctcggagatcgcagatcaccgaaaattttgaggatgcctcttgtacttctgatgtgtgtaattctgatgtactcatgtttcgatcgctgaacgtaaccccgtcatgtgtgtaaccattatgttttataaaacactgcttcgcccaagaagtcttgggttcaatttgaataaaaactttttccactataagtaagtacatacttaattacttaagccaaaaagatttggcggtgcctgtatataaaacttaacttgtataaattcagcttcgaaagctgcaataagtattttctaagaaagtataaatattaatattgggcctattaattattttataatgtctgattaagatactgttagcctaatgaaccgattatactacttattattatttacattccatatgggaaattgtatgtgaacttgtatgtttgcaaacgcacccacgacacatgaaaagatggtagtgtgggggcaacattaaaaaaaagttaagctaacagccacttaatcaacctggcctagtaatcaataagtattctaataaattgtgtattataattgtattaattaagctaaaaattactttgagacatattttatttaatcttttataagtaagctgcgaacacttgaataaaatcaacacttaaagaaatagacaaaggacagtattaggatattatggcatttaatacttataatgatgtttaatgtgatataaaaagaactacactacctacgtatatagttacctaccatattttgtttttaagttatatattttaagtaaaagtgatgtgcctaggatgcctttaatgtagttacctacctatgtcggtactgtattacaatgatacctaagaaataataatagaaattaaaacaattacattcttatttaatgtgttttatacaaacttatatgtagatttataaaattataaaaatctttacaagattacattaagcatggttaataatttaataaaaaaatattgtgcctattgtggttaatgtgcctctactttactgaatcaaattaaatctagatcacagtaattaagctaaagcaaccagtgataatgattaagatttgtttatttttgtaatttatttatgaccataggaaataaaattatattttttgttataaaaaactgtttttcgttttatttttgtcaccctgaattattcttgcgttttcttaaacccaaatttaataaaaaaagatttcgtagaaagtacacaagatagaacaaaggaaacagagtcacaataattttaagatcgcattgtttcatttaatacttagaaaccagtaaatcactttaaaacaaataatgagtaagttgcgtagtatatggggacacaaatgacccctaataaataactaggcatagtgcgtgcctccatgatttacagctgtttgttctttccgcacaaaacaagctgttacagtattgttttcctttcattgcattacaaaactttgaccaactattgtccagttttattgcaagagatctacttttatattatggatgaaatttggtgtcggtgtttatgtttcatattatggtaagtatttgttaggtaagtaggtaaatggatattccgtaatatctaacacaataaataaagcgaaaggtacatagtgacaagtcccgcatggaaacaatgtttgaataattcccagtacaattcccatcaaagcgcaattaataaaaattactcgtttcataaaacaattaacgtccagcggagcggcgcgcgcctgcggtcatctgatcggaatcatctccacgagccgccataaattcattgttttattatgtcacatccccgatgtgataaaaaaccgacaaattactaaattgagacatcccgctatctgccttatagacacgtgaagctctttaacgaataacacccatcataacataaaatagatcctatcgaaaaaccaatatgaccgagcctccatttttttccaccccagcgtgagctttatgctaatgaaacccaaaaacaaacattgttataagccaaatgtgtaacatacgataaaaataaattaaataataaagggaatcgttaaaatggaagaaatgtccgtaatttatccacgagtcaccttttaggcattccatggatgccatcgcgacggggtcccgcgagcccgcctgctctagacgcgatctccaaataaaaaggcgccacaaaaagacgtattcaataagccgttggccattaccggacgtaatcgatgagataaattagttataataaaatctgtggagctgtagacggccatagtaggtacggccgtcgaatgtctgagcagccccagagacgtgcatgggtcgtcatagtttgtagtaagtaactactacaaaaaacgaatgcttgtctatattaggtctaggtctctacttttcttgctgcaaaaaccatttgcagcaagataagtagaaataataaactaggtatctgtagttggtaattgaaggaattgaagttgataactacccaggctacgtaagtaactcgagataatttgttaatcgtgtggtgtgtgtagttcattatgcagtattcaaacgcgtatgagccggggacatgcagtgttgagtgtagtgaaaacgcacaaacgcgtcgcgagcaccgagtgttgaaacctaagaaaaaataccaggatcacattataaggctggaggtgagtttattttgtataaagtgattcttgaattcttttttatggtataaacgcacatgtgaatctcttgcacagtgtgtagtattctatgactgtgtactgcagtgaaaacgcacaaacgcgtcgcgggcactgagtgttcaaacttggcacaagcaccagtgtcgcataataatatggcaagagatgagttgactagttcataattttgtatctacaaaaccgcaagataaaccactgagagaagatactatcttctcttctcagctgtcagagatcactcttgtcagagtggtcgtggttaacacgtgatgggtccgatctgtctgcctgtcttataatgtgccgccgtcttagtgcactcatgcaaagacatacctacccaaaaattctgcaagttcttaccttttttagattttgacatatatggcaaaacattaaaagttaattaggacaatgccagttatgatgagatttaccatgtgtatggtaaaataatactatatgcttgatgtatctggcactagcggcagttcaggctcttgagtaggaaatgcaatctcaatctctagttcattttgagcgacattattatttttttttacttatctttgtttgatattgagatagctggttgtttctttcatttaatatttattttgtacatacgtcaaaatagaaatagtaaacaattcaaaatttgtaaaaaaaattgcttctgcctccaacttcgtctggccaccacattgcctttaggcaaaatcttttgttcgaatttccgagaaaaaaatatactcgtaaatcatttatcttaaaatctcattgtttttcacatttaaaatatgattatttttaaaaaataaacgattttgtcaaattgcaattgccaaatgtcaaaatggttacaaagtgagtggttataaaaagaaaaacaaaatgattctgtttcttaatttttattggtaaattcacattcaaataatagatcacgtcgaagacagatattacaatatgggatctctactgataaaatttagtaattatttgctatgatactgtatcggtacttttcaatttctaaatctactgctccattagctacatcgattttagagtgcgtaaatgcttcaaaattccagtgtcatgagtgagttcagctatgagaccttcaggaaaatagaaaatcgaaaatacacaattacattgttcacttacgaattcacgatacagatcggacatcaaaaatatttctatattaataaactactttcacataatcgttactaaaaaagacaaaacgcgtgcgagtcacgtcgcgcgtgacgcaaacgatacatgtgatcaaatttaatctaatcgattacttcattaatgatcgcgaactaccattctcgcggaatatattcacagacatttgttaagcatgcccatggtgatagtatgaagttaagaaacaaggcccggccggaccaccgggcagcgcacctgagattcagcgcccgcagccggccgcgcccaaacacatctctctgtcgcaccgctctcttctattgtacaaacattaccgtattaaatagtcacaggtcaatttcagtccaactatcagtttacgaattaaaataaaatatattaatctagaacgtttcacatcgcttaagttacgaatgaaggggtcgagtacggggtcgcgtgcggtgcgaggtctgcgggtgtgcgagcggacgctttacgagtcccaccagtcggggccgccgctgctgccgccgccgccgccgccgccgtacgacccgccgtagttaccgccgtacgacccgcccccgtatccgaaccctgcaacataaaacggccagttaggaaacatctttctttacaacgtctttgcacattttaatgcaataatactgaccagaaccaatagtagacggtcctgccgatcgtggagtctgacgcgattgagtacggaaatctcttgcgccaaagccactgccgctgcttgcgaagcgtcctccgccagacctgctgccagtccgacgtccgccgccgccaagacgcccatcagctgccgtgctcgtgagccaactggaaaataaatgggttataatgaattcgttataacttattggatgtctaaagacaactgttgcagggaaaaaatccgctaacgatacacctatgcaatgcatttgcagttattaacaagcagcttcaagaatattgatttgtcaaaagaccacattctaattcttattactggtggttcctgcaatgcctgttaccaaacaagataataaacgtaaattcttacttaggcacatcctgcttggcctcaacgaggagctcaacgaggtcccgcgcgaggccacggttagtgtcgttgaagaaggacgtggccacgcccaggttacccatacggccggtacgaccgatgcggtgcacgtactcctcaacgtcagacggcaaatcaaagttaatcacgtgacgcacgtgcggtatgtccaaacctgtatgaattaaacaattatcgataacattcattcattcatacgtttattatccataaagactataactaagactataatgtggaagtatgttgaaggatgtttaaggatattagtgataatttttactgaatttcattttatacggggcgtggcttacctctggccgcgacagcggtagcgacaagaatcggtgtctgtccggaacggaaccgacgcaaagcttcttcacgctcgcgctgggatcggtcaccgtggatggacgtgactgggtaaccaaggttatccaagaacacttccagttggtcggcacctgtacaaaaggttaggttaagtaagatcaagaaaagaagaagacagattataattcaatgtgaatgtttcaaattctattcgggaatctttcaacttaagttcacttagatttacttgaaattactttaaaaatttaattactcagaatataattgatgaatcagtgtcaaaatgtacctttcttagtttcaacaaatacaaggatcagctgatcctcttctgggcgtgcacgttgcagtaagttggaagcattcagcaaatccaataggaaagaacgcttatccatttcctccacccataccacctgaaagtttaaaatttatgtaaatctgttttgataatattaggtcaaatagttatacataaagttttatattatcatattcttatcatattaaaatattaccttctgggtgatattttcagatgtggaaccgacgcgtccaacagcaagaaaaacataattatataagaaatcctgcgctagcacttggatctgttttgggaaagtcgccgagaacatgagcgtctggcgctcgccagtctttggcatcgtgtggctctcgacaatcttgcgaatctgaggctcgaaacccatgtccagcatacggtcagcctcgtccag

SEQ ID NO: 338 - DNA, 5186 bp, Spodoptera frugiperda;
aggagtggccgttgctcagtggctcgtgcagtgaatttagtcaaaatgtttcagccgcgggttatgttaacgttcatggaggttccaaggaaaagaaccatggtggaaaccgggagccttgaggaaaggttccggttaataccaaccagcactaataccactccaaacaaggactcgaagggaaacgcgtggcaattgaaaccgggggaaaaggagaacgagaataaattaccagacccattaaatgaagatgtacagaaagggcaattctctgacacgagttcagaaccatctgaagccaaggctgaggaagtaccaagcataccttttattacactattcagatttgcatcgacaagggacaaactcttcataatctgcgcgttaatatgttccgcggtcgccgcaatatccacgccactgaacacactgttgcttgcgtacctactcgaagctatggtcaactacagcatctttggtgatgctgatgccttcatgaagtcgttactgaacttcgccatatacaacgcggcagtcggagcggcacttgtggttctgtcttacgctgccactactttgatgaacatcgctgcttataaccaagtatatgtaatacgacaagagtatttgaaagcagctctaaaccaggactttggatactttgatgttcataaaaatgcagaaatagctaacaaaatgaacagtgatataatgaagctggaagagggtatcggagagaagttagcgaccttcttcttctaccaggcttcgttcttaagcagcgtgatcatggcgctggtcaaaggatggaagcttgctctgctgtgcctcatctccttcccggtcaccatgacccttgtaggcgttgctggattgatagctgcaagtctttcaaagaaagaagctatagcgaccggtaaagcaggtgctatcgcggaggaggtgatatctgccatccggactgtgtacgccttcagtgggcaggagaaggagctcgacagatacgagggacacctcaatgatgccaggaagatcaatgttaagaagagtttgttcaacggtctggccatgggttgcctgttcttctgcatattctgcgcgtacgcactctccttctggttcggttacagactgatggtaacagatggatacgacgtttccaccatgattgctgtattcttcggtgtaatgactggttcagccaacttcggtatatcgtcgactctgatggaggtgttcggctcggcccgcggagccggcgctcacatcttcaacatgatcgacaatgtgcccaccatcaaccccctacagaaccggggcactgtgcccagtgatattgagggcaacatcgaactgaagaacgttgagttccactacccatccaggcctgatgttcctgtactaaaaggtgtgagtataaaggtgaagcgcggtcagtctgtggccctggtcggccactcaggctgcggcaagtccaccatcatacaactcatctccagattctacgacgtcgtcgaaggaagtgtcgcaatcgacggtaacgatgtccgcgacctatcagtccgttggctccgcgagcagatcggcctagtaggccaggagcccgtcctattcaacactaccgtccgggagaacattcggtatggacgtgagaatgccactaatgaggagatcgaagcctgcgccagacaagctaatgcacaccagttcatcatgaaactgccgaagggttacgacacactggtgggagagcgtggagcgtcactgtcaggtggtcagaaacaacgtatcgccattgctcgagctttggtacggaacccgaagatattgctactggatgaggctacctccgccctcgacacctcttctgaagccaaagtacagaaagcacttgataaggcacaagaaggtcgcacgacaatagtggtggctcacagactgtccacaatcaggaacgtcgatgtgatatacgtgttcaaggctggtttggtggtggaatgtggcaaccacacagaactgatggccagcaagggacactactatgatatggtgatgctgcagaacctgcctggcgtggatgagcagtcgcctgaaaaaaccaaattgtctcgcgagacttccataatcagtgaaaaagatgacgaagacgagttcttggaattccggaatgatgacaaagaagaggacgcaaccgaagctcccgacatttccttcatgagagtgttgaagctgaacaagccggagtggaagtccgtcaccctggccagcatctgttctctcatgagcggcttctgcatgccactgttcgccgtcatctttggagacttccttgcgttactcgatggcgacgatcctgacgaaattcaaaaaggagtgtcacgattggcgttgatctttgtcggcatcggtgtgttctctggcatcactaacttcattgtggtattcttctacggaatagcaggtgaagcgttgaccaagcggctgcggctgatgatgttcaggaagctgctggagatggacatcgggttctatgacgacaaggacaactccaccggagcactctgcgccagactgtctggagaggcagccgcggtccaaggggctacaggtcaaagaatcggtacagtggtacaggcagttggtacattcggcttcgctctggtactgtccctgatcttcgagtggcgagtgggtctggtggcgctgaccttcgtgcccatcatcatattcgtgctgtacaaggagggccgcatgacttacgccgctacttctggcaccgtcaaggtcatggagactagttctaagatagccgtagaagccgtggccaacgtccggacggtagcgtcgctgggtcgcgaggagacgttccgtcgcgagtactcgaagcagctccgtcctgcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagccctattgatgggtgctacgtcagcggcgcaggcgtttgccttcgctcccaacttccagaagggcatcaaggcagcaggccgtgtcattgtactactgggaagacagtccaagatcactgacccagctgaacctgctgtcaaacacttcaacggtacaggagaagcaagtctgcagggcattcagttcaggtacccgacccggcctctggtgcgcgtactgaaggacctgaacctggagatacagcgcgggaagaccgtggcgctggtgggggccagcggctgcgggaagagcaccgtcatacaactgctcgagaggtactacgatcctgaagacggcattgtggctcaagacggcgtcccgctaccgaagctgaacctagtagacgctcgacgcgcgatcggcttcgtgcagcaagagccgatcctgttcgaccgcaccatcggcgagaacatcgcgtacgggaacaacgaggcgcgcgtctccaacgacgaggtcatcgaggcagcccagcaggccaacatacacaactttatcacgtcactgcctttgggttacgacacaaacatcggatctaaaggcacgcagctatcaggtggacagaagcagagagtggccatcgcgcgcgctctcatacggagacccaagatgttactgctggacgaagccaccagcgcactcgacactgagagcgaaaaggtggtacaagaagcattagataaagcgaaggcaggccgtacgtgtgtgatgatagctcatagactcagtacagtcagggacgctgacgtcatctgcgtcatccacgagggacaggtcgcagaaatggggacacataacgaactactcgaacttaaaggactgtactacaacttaaataggagaggatacgcttaagttatctatttataggtataggagtatttacttaatatagatggttagtcaaacagtctcacagcgcttggcaggctcggagatcgcagatcaccgaaaattttgaggatgcctcttgtacttctgatgtgtgtaattctgatgtactcatgtttcgatcgctgaacgtaaccccgtcatgtgtgtaaccattatgttttataaaacactgcttcgcccaagaagtcttgggttcaatttgaataaaaactttttccactataagtaagtacatacttaattacttaagccaaaaagatttggcggtgcctgtatataaaacttaacttgtataaattcagcttcgaaagctgcaataagtattttctaagaaagtataaatattaatattgggcctattaattattttataatgtctgattaagatactgttagcctaatgaaccgattatactacttattattatttacattccatatgggaaattgtatgtgaacttgtatgtttgcaaacgcacccacgacacatgaaaagatggtagtgtgggggcaacattaaaaaaaagttaagctaacagccacttaatcaacctggcctagtaatcaataagtattctaataaattgtgtattataattgtattaattaagctaaaaattactttgagacatattttatttaatcttttataagtaagctgcgaacacttgaataaaatcaacacttaaagaaatagacaaaggacagtattaggatattatggcatttaatacttataatgatgtttaatgtgatataaaaagaactacactacctacgtatatagttacctaccatattttgtttttaagttatatattttaagtaaaagtgatgtgcctaggatgcctttaatgtagttacctacctatgtcggtactgtattacaatgatacctaagaaataataatagaaattaaaacaattacattcttatttaatgtgttttatacaaacttatatgtagatttataaaattataaaaatctttacaagattacattaagcatggttaataatttaataaaaaaatattgtgcctattgtggttaatgtgcctctactttactgaatcaaattaaatctagatcacagtaattaagctaaagcaaccagtgataatgattaagatttgtttatttttgtaatttatttatgaccataggaaataaaattatattttttgttataaaaaa

SEQ ID NO: 339 - DNA, 5199 bp, Spodoptera frugiperda;
gatacattcaaaccaatcccatacaggccatacaatttgatgagcacaatcattttgcgagtatattccgcgggttatgttaacgttcatggaggttccaaggaaaagaaccatggtggaaaccgggagccttgaggaaaggttccggttaataccaaccagcactaataccactccaaacaaggactcgaagggaaacgcgtggcaattgaaaccgggggaaaaggagaacgagaataaattaccagacccattaaatgaagatgtacagaaagggcaattctctgacacgagttcagaaccatctgaagccaaggctgaggaagtaccaagcataccttttattacactattcagatttgcatcgacaagggacaaactcttcataatctgcgcgttaatatgttccgcggtcgccgcaatatccacgccactgaacacactgttgcttgcgtacctactcgaagctatggtcaactacagcatctttggtgatgctgatgccttcatgaagtcgttactgaacttcgccatatacaacgcggcagtcggagcggcacttgtggttctgtcttacgctgccactactttgatgaacatcgctgcttataaccaagtatatgtaatacgacaagagtatttgaaagcagctctaaaccaggactttggatactttgatgttcataaaaatgcagaaatagctaacaaaatgaacagtgatataatgaagctggaagagggtatcggagagaagttagcgaccttcttcttctaccaggcttcgttcttaagcagcgtgatcatggcgctggtcaaaggatggaagcttgctctgctgtgcctcatctccttcccggtcaccatgacccttgtaggcgttgctggattgatagctgcaagtctttcaaagaaagaagctatagcgaccggtaaagcaggtgctatcgcggaggaggtgatatctgccatccggactgtgtacgccttcagtgggcaggagaaggagctcgacagatacgagggacacctcaatgatgccaggaagatcaatgttaagaagagtttgttcaacggtctggccatgggttgcctgttcttctgcatattctgcgcgtacgcactctccttctggttcggttacagactgatggtaacagatggatacgacgtttccaccatgattgctgtattcttcggtgtaatgactggttcagccaacttcggtatatcgtcgactctgatggaggtgttcggctcggcccgcggagccggcgctcacatcttcaacatgatcgacaatgtgcccaccatcaaccccctacagaaccggggcactgtgcccagtgatattgagggcaacatcgaactgaagaacgttgagttccactacccatccaggcctgatgttcctgtactaaaaggtgtgagtataaaggtgaagcgcggtcagtctgtggccctggtcggccactcaggctgcggcaagtccaccatcatacaactcatctccagattctacgacgtcgtcgaaggaagtgtcgcaatcgacggtaacgatgtccgcgacctatcagtccgttggctccgcgagcagatcggcctagtaggccaggagcccgtcctattcaacactaccgtccgggagaacattcggtatggacgtgagaatgccactaatgaggagatcgaagcctgcgccagacaagctaatgcacaccagttcatcatgaaactgccgaagggttacgacacactggtgggagagcgtggagcgtcactgtcaggtggtcagaaacaacgtatcgccattgctcgagctttggtacggaacccgaagatattgctactggatgaggctacctccgccctcgacacctcttctgaagccaaagtacagaaagcacttgataaggcacaagaaggtcgcacgacaatagtggtggctcacagactgtccacaatcaggaacgtcgatgtgatatacgtgttcaaggctggtttggtggtggaatgtggcaaccacacagaactgatggccagcaagggacactactatgatatggtgatgctgcagaacctgcctggcgtggatgagcagtcgcctgaaaaaaccaaattgtctcgcgagacttccataatcagtgaaaaagatgacgaagacgagttcttggaattccggaatgatgacaaagaagaggacgcaaccgaagctcccgacatttccttcatgagagtgttgaagctgaacaagccggagtggaagtccgtcaccctggccagcatctgttctctcatgagcggcttctgcatgccactgttcgccgtcatctttggagacttccttgcgttactcgatggcgacgatcctgacgaaattcaaaaaggagtgtcacgattggcgttgatctttgtcggcatcggtgtgttctctggcatcactaacttcattgtggtattcttctacggaatagcaggtgaagcgttgaccaagcggctgcggctgatgatgttcaggaagctgctggagatggacatcgggttctatgacgacaaggacaactccaccggagcactctgcgccagactgtctggagaggcagccgcggtccaaggggctacaggtcaaagaatcggtacagtggtacaggcagttggtacattcggcttcgctctggtactgtccctgatcttcgagtggcgagtgggtctggtggcgctgaccttcgtgcccatcatcatattcgtgctgtacaaggagggccgcatgacttacgccgctacttctggcaccgtcaaggtcatggagactagttctaagatagccgtagaagccgtggccaacgtccggacggtagcgtcgctgggtcgcgaggagacgttccgtcgcgagtactcgaagcagctccgtcctgcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagccctattgatgggtgctacgtcagcggcgcaggcgtttgccttcgctcccaacttccagaagggcatcaaggcagcaggccgtgtcattgtactactgggaagacagtccaagatcactgacccagctgaacctgctgtcaaacacttcaacggtacaggagaagcaagtctgcagggcattcagttcaggtacccgacccggcctctggtgcgcgtactgaaggacctgaacctggagatacagcgcgggaagaccgtggcgctggtgggggccagcggctgcgggaagagcaccgtcatacaactgctcgagaggtactacgatcctgaagacggcattgtggctcaagacggcgtcccgctaccgaagctgaacctagtagacgctcgacgcgcgatcggcttcgtgcagcaagagccgatcctgttcgaccgcaccatcggcgagaacatcgcgtacgggaacaacgaggcgcgcgtctccaacgacgaggtcatcgaggcagcccagcaggccaacatacacaactttatcacgtcactgcctttgggttacgacacaaacatcggatctaaaggcacgcagctatcaggtggacagaagcagagagtggccatcgcgcgcgctctcatacggagacccaagatgttactgctggacgaagccaccagcgcactcgacactgagagcgaaaaggtggtacaagaagcattagataaagcgaaggcaggccgtacgtgtgtgatgatagctcatagactcagtacagtcagggacgctgacgtcatctgcgtcatccacgagggacaggtcgcagaaatggggacacataacgaactactcgaacttaaaggactgtactacaacttaaataggagaggatacgcttaagttatctatttataggtataggagtatttacttaatatagatggttagtcaaacagtctcacagcgcttggcaggctcggagatcgcagatcaccgaaaattttgaggatgcctcttgtacttctgatgtgtgtaattctgatgtactcatgtttcgatcgctgaacgtaaccccgtcatgtgtgtaaccattatgttttataaaacactgcttcgcccaagaagtcttgggttcaatttgaataaaaactttttccactataagtaagtacatacttaattacttaagccaaaaagatttggcggtgcctgtatataaaacttaacttgtataaattcagcttcgaaagctgcaataagtattttctaagaaagtataaatattaatattgggcctattaattattttataatgtctgattaagatactgttagcctaatgaaccgattatactacttattattatttacattccatatgggaaattgtatgtgaacttgtatgtttgcaaacgcacccacgacacatgaaaagatggtagtgtgggggcaacattaaaaaaaagttaagctaacagccacttaatcaacctggcctagtaatcaataagtattctaataaattgtgtattataattgtattaattaagctaaaaattactttgagacatattttatttaatcttttataagtaagctgcgaacacttgaataaaatcaacacttaaagaaatagacaaaggacagtattaggatattatggcatttaatacttataatgatgtttaatgtgatataaaaagaactacactacctacgtatatagttacctaccatattttgtttttaagttatatattttaagtaaaagtgatgtgcctaggatgcctttaatgtagttacctacctatgtcggtactgtattacaatgatacctaagaaataataatagaaattaaaacaattacattcttatttaatgtgttttatacaaacttatatgtagatttataaaattataaaaatctttacaagattacattaagcatggttaataatttaataaaaaaatattgtgcctattgtggttaatgtgcctctactttactgaatcaaattaaatctagatcacagtaattaagctaaagcaaccagtgataatgattaagatttgtttatttttgtaatttatttatgaccataggaaataaaattatattttttgttataaaaaa

SEQ ID NO: 340 - DNA, 3906 bp, Spodoptera frugiperda;
atgtttcagccgcgggttatgttaacgttcatggaggttccaaggaaaagaaccatggtggaaaccgggagccttgaggaaaggttccggttaataccaaccagcactaataccactccaaacaaggactcgaagggaaacgcgtggcaattgaaaccgggggaaaaggagaacgagaataaattaccagacccattaaatgaagatgtacagaaagggcaattctctgacacgagttcagaaccatctgaagccaaggctgaggaagtaccaagcataccttttattacactattcagatttgcatcgacaagggacaaactcttcataatctgcgcgttaatatgttccgcggtcgccgcaatatccacgccactgaacacactgttgcttgcgtacctactcgaagctatggtcaactacagcatctttggtgatgctgatgccttcatgaagtcgttactgaacttcgccatatacaacgcggcagtcggagcggcacttgtggttctgtcttacgctgccactactttgatgaacatcgctgcttataaccaagtatatgtaatacgacaagagtatttgaaagcagctctaaaccaggactttggatactttgatgttcataaaaatgcagaaatagctaacaaaatgaacagtgatataatgaagctggaagagggtatcggagagaagttagcgaccttcttcttctaccaggcttcgttcttaagcagcgtgatcatggcgctggtcaaaggatggaagcttgctctgctgtgcctcatctccttcccggtcaccatgacccttgtaggcgttgctggattgatagctgcaagtctttcaaagaaagaagctatagcgaccggtaaagcaggtgctatcgcggaggaggtgatatctgccatccggactgtgtacgccttcagtgggcaggagaaggagctcgacagatacgagggacacctcaatgatgccaggaagatcaatgttaagaagagtttgttcaacggtctggccatgggttgcctgttcttctgcatattctgcgcgtacgcactctccttctggttcggttacagactgatggtaacagatggatacgacgtttccaccatgattgctgtattcttcggtgtaatgactggttcagccaacttcggtatatcgtcgactctgatggaggtgttcggctcggcccgcggagccggcgctcacatcttcaacatgatcgacaatgtgcccaccatcaaccccctacagaaccggggcactgtgcccagtgatattgagggcaacatcgaactgaagaacgttgagttccactacccatccaggcctgatgttcctgtactaaaaggtgtgagtataaaggtgaagcgcggtcagtctgtggccctggtcggccactcaggctgcggcaagtccaccatcatacaactcatctccagattctacgacgtcgtcgaaggaagtgtcgcaatcgacggtaacgatgtccgcgacctatcagtccgttggctccgcgagcagatcggcctagtaggccaggagcccgtcctattcaacactaccgtccgggagaacattcggtatggacgtgagaatgccactaatgaggagatcgaagcctgcgccagacaagctaatgcacaccagttcatcatgaaactgccgaagggttacgacacactggtgggagagcgtggagcgtcactgtcaggtggtcagaaacaacgtatcgccattgctcgagctttggtacggaacccgaagatattgctactggatgaggctacctccgccctcgacacctcttctgaagccaaagtacagaaagcacttgataaggcacaagaaggtcgcacgacaatagtggtggctcacagactgtccacaatcaggaacgtcgatgtgatatacgtgttcaaggctggtttggtggtggaatgtggcaaccacacagaactgatggccagcaagggacactactatgatatggtgatgctgcagaacctgcctggcgtggatgagcagtcgcctgaaaaaaccaaattgtctcgcgagacttccataatcagtgaaaaagatgacgaagacgagttcttggaattccggaatgatgacaaagaagaggacgcaaccgaagctcccgacatttccttcatgagagtgttgaagctgaacaagccggagtggaagtccgtcaccctggccagcatctgttctctcatgagcggcttctgcatgccactgttcgccgtcatctttggagacttccttgcgttactcgatggcgacgatcctgacgaaattcaaaaaggagtgtcacgattggcgttgatctttgtcggcatcggtgtgttctctggcatcactaacttcattgtggtattcttctacggaatagcaggtgaagcgttgaccaagcggctgcggctgatgatgttcaggaagctgctggagatggacatcgggttctatgacgacaaggacaactccaccggagcactctgcgccagactgtctggagaggcagccgcggtccaaggggctacaggtcaaagaatcggtacagtggtacaggcagttggtacattcggcttcgctctggtactgtccctgatcttcgagtggcgagtgggtctggtggcgctgaccttcgtgcccatcatcatattcgtgctgtacaaggagggccgcatgacttacgccgctacttctggcaccgtcaaggtcatggagactagttctaagatagccgtagaagccgtggccaacgtccggacggtagcgtcgctgggtcgcgaggagacgttccgtcgcgagtactcgaagcagctccgtcctgcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagccctattgatgggtgctacgtcagcggcgcaggcgtttgccttcgctcccaacttccagaagggcatcaaggcagcaggccgtgtcattgtactactgggaagacagtccaagatcactgacccagctgaacctgctgtcaaacacttcaacggtacaggagaagcaagtctgcagggcattcagttcaggtacccgacccggcctctggtgcgcgtactgaaggacctgaacctggagatacagcgcgggaagaccgtggcgctggtgggggccagcggctgcgggaagagcaccgtcatacaactgctcgagaggtactacgatcctgaagacggcattgtggctcaagacggcgtcccgctaccgaagctgaacctagtagacgctcgacgcgcgatcggcttcgtgcagcaagagccgatcctgttcgaccgcaccatcggcgagaacatcgcgtacgggaacaacgaggcgcgcgtctccaacgacgaggtcatcgaggcagcccagcaggccaacatacacaactttatcacgtcactgcctttgggttacgacacaaacatcggatctaaaggcacgcagctatcaggtggacagaagcagagagtggccatcgcgcgcgctctcatacggagacccaagatgttactgctggacgaagccaccagcgcactcgacactgagagcgaaaaggtggtacaagaagcattagataaagcgaaggcaggccgtacgtgtgtgatgatagctcatagactcagtacagtcagggacgctgacgtcatctgcgtcatccacgagggacaggtcgcagaaatggggacacataacgaactactcgaacttaaaggactgtactacaacttaaataggagaggatacgcttaa

SEQ ID NO: 341 - DNA, 3888 bp, Spodoptera frugiperda;
atgttaacgttcatggaggttccaaggaaaagaaccatggtggaaaccgggagccttgaggaaaggttccggttaataccaaccagcactaataccactccaaacaaggactcgaagggaaacgcgtggcaattgaaaccgggggaaaaggagaacgagaataaattaccagacccattaaatgaagatgtacagaaagggcaattctctgacacgagttcagaaccatctgaagccaaggctgaggaagtaccaagcataccttttattacactattcagatttgcatcgacaagggacaaactcttcataatctgcgcgttaatatgttccgcggtcgccgcaatatccacgccactgaacacactgttgcttgcgtacctactcgaagctatggtcaactacagcatctttggtgatgctgatgccttcatgaagtcgttactgaacttcgccatatacaacgcggcagtcggagcggcacttgtggttctgtcttacgctgccactactttgatgaacatcgctgcttataaccaagtatatgtaatacgacaagagtatttgaaagcagctctaaaccaggactttggatactttgatgttcataaaaatgcagaaatagctaacaaaatgaacagtgatataatgaagctggaagagggtatcggagagaagttagcgaccttcttcttctaccaggcttcgttcttaagcagcgtgatcatggcgctggtcaaaggatggaagcttgctctgctgtgcctcatctccttcccggtcaccatgacccttgtaggcgttgctggattgatagctgcaagtctttcaaagaaagaagctatagcgaccggtaaagcaggtgctatcgcggaggaggtgatatctgccatccggactgtgtacgccttcagtgggcaggagaaggagctcgacagatacgagggacacctcaatgatgccaggaagatcaatgttaagaagagtttgttcaacggtctggccatgggttgcctgttcttctgcatattctgcgcgtacgcactctccttctggttcggttacagactgatggtaacagatggatacgacgtttccaccatgattgctgtattcttcggtgtaatgactggttcagccaacttcggtatatcgtcgactctgatggaggtgttcggctcggcccgcggagccggcgctcacatcttcaacatgatcgacaatgtgcccaccatcaaccccctacagaaccggggcactgtgcccagtgatattgagggcaacatcgaactgaagaacgttgagttccactacccatccaggcctgatgttcctgtactaaaaggtgtgagtataaaggtgaagcgcggtcagtctgtggccctggtcggccactcaggctgcggcaagtccaccatcatacaactcatctccagattctacgacgtcgtcgaaggaagtgtcgcaatcgacggtaacgatgtccgcgacctatcagtccgttggctccgcgagcagatcggcctagtaggccaggagcccgtcctattcaacactaccgtccgggagaacattcggtatggacgtgagaatgccactaatgaggagatcgaagcctgcgccagacaagctaatgcacaccagttcatcatgaaactgccgaagggttacgacacactggtgggagagcgtggagcgtcactgtcaggtggtcagaaacaacgtatcgccattgctcgagctttggtacggaacccgaagatattgctactggatgaggctacctccgccctcgacacctcttctgaagccaaagtacagaaagcacttgataaggcacaagaaggtcgcacgacaatagtggtggctcacagactgtccacaatcaggaacgtcgatgtgatatacgtgttcaaggctggtttggtggtggaatgtggcaaccacacagaactgatggccagcaagggacactactatgatatggtgatgctgcagaacctgcctggcgtggatgagcagtcgcctgaaaaaaccaaattgtctcgcgagacttccataatcagtgaaaaagatgacgaagacgagttcttggaattccggaatgatgacaaagaagaggacgcaaccgaagctcccgacatttccttcatgagagtgttgaagctgaacaagccggagtggaagtccgtcaccctggccagcatctgttctctcatgagcggcttctgcatgccactgttcgccgtcatctttggagacttccttgcgttactcgatggcgacgatcctgacgaaattcaaaaaggagtgtcacgattggcgttgatctttgtcggcatcggtgtgttctctggcatcactaacttcattgtggtattcttctacggaatagcaggtgaagcgttgaccaagcggctgcggctgatgatgttcaggaagctgctggagatggacatcgggttctatgacgacaaggacaactccaccggagcactctgcgccagactgtctggagaggcagccgcggtccaaggggctacaggtcaaagaatcggtacagtggtacaggcagttggtacattcggcttcgctctggtactgtccctgatcttcgagtggcgagtgggtctggtggcgctgaccttcgtgcccatcatcatattcgtgctgtacaaggagggccgcatgacttacgccgctacttctggcaccgtcaaggtcatggagactagttctaagatagccgtagaagccgtggccaacgtccggacggtagcgtcgctgggtcgcgaggagacgttccgtcgcgagtactcgaagcagctccgtcctgcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagccctattgatgggtgctacgtcagcggcgcaggcgtttgccttcgctcccaacttccagaagggcatcaaggcagcaggccgtgtcattgtactactgggaagacagtccaagatcactgacccagctgaacctgctgtcaaacacttcaacggtacaggagaagcaagtctgcagggcattcagttcaggtacccgacccggcctctggtgcgcgtactgaaggacctgaacctggagatacagcgcgggaagaccgtggcgctggtgggggccagcggctgcgggaagagcaccgtcatacaactgctcgagaggtactacgatcctgaagacggcattgtggctcaagacggcgtcccgctaccgaagctgaacctagtagacgctcgacgcgcgatcggcttcgtgcagcaagagccgatcctgttcgaccgcaccatcggcgagaacatcgcgtacgggaacaacgaggcgcgcgtctccaacgacgaggtcatcgaggcagcccagcaggccaacatacacaactttatcacgtcactgcctttgggttacgacacaaacatcggatctaaaggcacgcagctatcaggtggacagaagcagagagtggccatcgcgcgcgctctcatacggagacccaagatgttactgctggacgaagccaccagcgcactcgacactgagagcgaaaaggtggtacaagaagcattagataaagcgaaggcaggccgtacgtgtgtgatgatagctcatagactcagtacagtcagggacgctgacgtcatctgcgtcatccacgagggacaggtcgcagaaatggggacacataacgaactactcgaacttaaaggactgtactacaacttaaataggagaggatacgcttaa

SEQ ID NO: 342 - DNA, 32685 bp, Spodoptera frugiperda;
tattgaaggaaataaatttaataaattacctacttttatctttaccattatagttatattgctttattatctttattcttatttgtattacttaaaacactcaatattaggacttatttacaattaagaaaacatgtagagattattaaattacaaacagtctttgtactgattatattaaaaattgtattgaagttcattgactaagtgcgctgttagcttaaaatgtcaatcaagactagacaggcatgactataaattgaattgtaacgtaagaccaatctttaaaaaataaacaaaatgtttcattttattgtcttacattatagtaatacaatgcttatatatatacttatacttatatatatacttatattcataatagttgcgcctagacaagtatctaaagattaactctgtccctataatgaaataacttaaattcctccggtcatcatcacaaagcccgatcaatgtatcaatagtagtattatacagtgtaaggaaatatgaattggaagacttgaatttaaaattatttaatactttttctaggtaaactttcatcatgcaaagtaaaaccgtaaaccgctgcaaagtaaaaccatattttcacaaggtttgagaattcaccatgcttgctcaaggtgggatagcgatttcaaacttataattaagaattataagaccaggtttgcatacaatgtttatggtaattgcttgcttgatttataaaaataccaagagctagaaaaaaaatatgtgcatcatgtaagtaactctattcatgtagtagtaaactttatttcttattatatatttttatttatattatatagagttacctacaccactcagtttcttttttgactaacatgagatctggtttttcttagatgtgcacatctaaccaatcatcccccgataggatgatacctacttggtcatctccagatagatagttacgttaaattatgattttatcaattaatttacgtagtaacttgagtactacttacctacttaatatttgacacagagatttcattaatttattctactgacaagtagagctacactttagtcaagatgtaaaaataaatattaaacctatttacggtcatttaattaatgtaatttacctcattgtttttataatttttaattattcatttatccttcctgaatcttggcattaaacttttttccaacataatcaaacaaattaacaacacaaacttcaaatttcggggttcattgaacttaacctcatgaagttatcagttgatgttcagtttcattcattccaaattgggttgcccattattttattatccgtgtatataaaaaaatatgaataattgtgaaataaaagtaaaattttattttggtcattaaagcatgcatcaaatttttaataaactactttttattcaaagtaatggtcatttatagaagaagagttaacatttgccaaaatattttgttgtaatttctatgggggtggcaaccctacgaatcttggcctttgatattggcttaggccttctcccgcctcttcaatcacttcaatggttccgtgagtcatttcattgtctattatattaaattaattaccattattttgtagttgcataaaaaaatactctgctcattatttaaaaaagaaataactttttatgtaattatgtagacacttgatagcgttacgtaggtacttaggtacttacttacattttatgaaattcaaacttttacaaaacagaaaatctaactctttgaacttggtaagttggtactcagcacaagtaccaattacctgaaagttaatttaagtaatttaattgaagtaattttattgcaaatttaggtagatactctattattgctagatagtagacaagaccggcaaacagatgaccgaagtatgacgtcacaaatgatattcaccctacagagggaggattatgacgtcagagggcttaaatatgcgcatcttaagaaattgggagtatttctctcagatttcggagtgcttagtatgacgacgacgtgctaacaatgccgcgtagtcaaggttagataacgacatgtgaattttaactaaatatccgcgtagacgtaaaaatatagacaaataacatgaagacacttcctaacacacacacacatgtgcctactaggttggtaactacatatttacttactttattatttatgtaggcaggtagataggtacctgaatcggactagtagaatagatagagttcaacgacttactgttaaaagttaaaataaatactcacctaatattaagtaaatatcgcatggtatttcctcctggtatcgcagagtacgaagttacataatgaatgatttgtcgtatttggtgctactatggacgtctacttactaacatggttccatacagatacattcaaaccaatcccatacaggccatacaatttgatgagcacaatcattttgccagtatattgttagttagtttaatgatttgcgaggagtggccgctgctcactggctcgtgcagtgaatttagtcaaaatgtttcagccgcgggttatgttaacgttcatggaggtgccaaggaaaagaaccatggtggaagccgggagccttgaggaaaggttccggttgataccaaccagcgctaataccaccccaaacaaggtaagagtaaatttgaatgtgtgtgagtgacgcgcgaaattgaatgttttaagttgttactatgtcctttcattactgtaacagtttattgccttacaaaaatagctactgtttaaaaatttacgtactaattcattacaaagaataaaagaaaaagactttacaagtaataaattatgatacaatagataatgttttcatttgggacatgggacaaataataaagcaatctattcaatcaataaccggaatttaaaggaaatgtgtcactcaaacattagttacgcccaactaaaatgtaacagggcattgtcaaaattgtcgtggaagtgaaaaaaagggctggacaatgtacgaattctaaggaatgatgcacccaacgtgttgtttacaaacagactgagcgaaataatagtgcagtgaaacttgtggcccaccgtgaccgaactgacgagaatagcggtgcgccataaatcactggcataatgaacattgtcattgctcacttttcgtttttatacaagataatttaaatttggaataataaggtattggtgacatttcagaattttcttagaagtttgatgacgtagttttttttgttagaggttgttgacttgtactcttgttgtacttacctaggctccgttaactttattacaattacattgtgcatattttactaaacaattgaagttatcccttcaaacattagctaaagtaaacaaatagtttcaagtccttgtcaacacagcctcaaaaaagtacttgcctatttgcatttttttctcagctgtttatttacgttactaagcaaaatttgctaaacggagccccgtagacaccaccaaacttttgccctagaatatattctaataataaatcttagtgaacttacattggcgctatagctgatttaccgactgctacgcaacgtgtcgtgggttcgatttgtacttgttgcaataactcattatgggattttacacagttgttttggggtttatgtgtatgtaattttttatgtttgtaaacacttccatgacacagatgaagacgtaacttagtgtgggactacgctcaaaaaaatatttcacgattccctagaagtaggtaagtaaactacatacacacgggtaggtacctacgtaggtacttagtcctgaaaagataaaaaaattacctatgtatcagtcattcctacttctactactattcctaccaagaagtcataacttaccattcatgcttcaccctatttctcgctcacaaccggccatggaaaagctcgcaacctaaagtcagctgtttacgcaataatcgataaaactacggtgcggtcaaccgtcaccgcacactcgtaggcgacaaggcctatctttatagcttttatgatattcctgaaacatcttctcgaataattttcaatagaaattacttctagaatattgttaaaagccattatgataaaagttacaattactacctacaataataaaaacgtaatcttgatcaatcgtagtcgtatgattaggaaataatcgtcgccgtcgtatcgtagcaacgatgacaaaaaataaatacaaacatttctcaattcaataaaaatatgtatttgtagtgttttgtttcgagtgtacatacatttgttgtcaactagttaattattgatagctagtatttatttatggtaaatgtgacgcatgatccatatacgatttgaaagcacagttactgaacccttaatttatcgtggcttatgaaagctttacatacagtctaaccctagctgttgaaagtcgagctttcataatacatacatagatacatagagtcaataactatgtatgtataagcataaacagaatgatatacatataggaacaactcacagttacctgtgtgactcatgagtgcaatgtaaagatcattaagacccgccagagctgcgtaaaacaaacaaactttcgcgttatttcgcgccgactttcaaactatttgtagcttttcacacttcaagggaacttgtcggccattgacgcacttacactgttctaaaccaaacgttgtattataatcgagtttcagttctacagcacctttcacgttttatcgacctgataaattgataacgtatcatggatgcgttagtcgcgattgggaggaccgcggataaacgtttcagccgatatatacggctgacttaattcattgtgaattagtataatgagtttttaaacacagtagctgtctgtagttgtagtgtggcctgttgttgtgtgaataattcagttaattaattgttcaaaatgaaggactcgaagggaaacgcgtggcaattgaaaccaggggaaaaggagaacgagaataaattaccagacccattgaatgaagatgtacagaaaggacaattctctgacacgtaagtttaccttgttattgcatattattatttataccaatgtaaacaatctgttgattgtcgaacaatagccaacaagtaaatattttcttagtgcaatcagtggaaacggatccctagaactcctagaagcgaatgacactgagcgtgaattgtttcaattgatcaacaaatctattatcaacaatacagacgcacaccagttgtaacattatgtatactatactacacttatattctccgcgcaattgcaattaaatattatgaaacattggactaattcgccgagactgattaaatatgatctcatcacgagactgggccgcactggcttgcctcagctattccttaaccatgggttaaaaataaaacaaactatttttatgaaacgtccagattgcggcgctagtttcctactgatcgccaaagtacaaatccatcaatagtatctgtatgacgtgtaaatagcaaggttacatgtagttgtaggtatatttttttataacaaaagtcgagataaaattccgtataagtacataaattttatgttttacgtggttttatcgaaatagaattataatcgtagataagtgaatatttagttgtgatagtattgttattatttttattgtgcaaactattcgtggtgcgccatccactcttacagggaatgttttgtttcagtacactagaatataatattaattcttattgatgctaaattagatgaatactcaaaatgaaaaagctagtttcgctgtacggtaacacaatcgattttgattccctgtagccttgatcctgaccttggttgtggcaaacaccacgtgggatacatttcataaacacaggcgagtcgtactcgcaaacaaatctaaaatagaccatatccgcatacttaggtataatatttttatgacgctattgaattacgctaattatcgtgaaaaaaggactgaagatatgggtgtcttgcacaccattgtgcacgcgttttgtcattaagaaaataccacaaatttgaatctatgtagaaatatataagtagacttttgtgttccaaaatttaatcgcctttaataggtttatggctataatttgtttatcatttcattacaacagacagtcttgtttaatctattacctacctactagctttcctacatattatattttttacgtacaaagttcatttgactaaattttttgatgatagaggtaatttaaaatctgtttatgagatcaatcgaatcttgtatttgcgaaaattaagctacgttaatacattttatacttcggaccaccgccaccggacctctgttgttacgcatttaccttaaacttaatagttaatacgttttactatgtcttttaattgcattgtatttttgcaggagttcagaaccatctgaagccaaggctgaggaagtaccaagtataccttttatcacactagtgagtatattaatttgaatgtcaaatagcttataacaaagtacagtaaaaatcgaagtaaaactaaagtgacaacacaaaactaaccgccgccgtactcagaaacctttaatgattaggtacttacctaaactattccttagtaacgaatttgttccgaaaacaatcgctaaggactgggttaagtaaccattaaatgactctgactacggcgggataacacctaggaaatgtacgttttatgaaaatgaaacattaatgaatgaactcttaagacgttttaaaagttcctacatgcagattgcactctcaattacactctaagtcaaaatatagagtgcagtctttcaataccctttgttatttacatatcgagtaccggtacggtatgtagatgtggacattaattatttaaaacgtgtcttaaaaaaccttctaatgggtatgtcttttatagaaaataacggtaaattagggtgaattgttatctactattacggttatattttcgtctatttccgtgtttgtaagcactaaagccacagaatatcacagtataagcataccgtatcgatcgggcggagtagtgaaacgacgtctaattaacttgctacccatgactgttgctgacgttagtaaactacattggaaatggaatgtccatgtagccattacaccttatcagctgaacatagacgtgcgtaggaaacaaatacccttatttaagttgaaaataaaagggaaattagattgtgtgacatgtagattagaaaattttgtacgttatgtgacgtattattttattgggtttattaatttatttaaaaaatcactgaacacggtatactaatgaaagtcatacataggtttcgttaaggctccggccccactagtccgttgcgctgcgttgcgtcgcgacgacgtaaaggtgtaacgggccttgtcatctatacatataataaaatcgtagaaaagtgctgtctgtacattgaaaataaaaataaaaaaaatagcaggggttattgttatgtcgatgtcgaacccaaaaatgtaattaactttttttttgtctgtttgtctgtttgtctgtttgtctgtttgtctgttcgtctgtgcgcgctaatctcagaaacagctgatccgagttggatgcggttttcacgaatatattgtgggatgcttaaatttacatttagtgtttgtttcatgtcaatcggttcataaataaaaaagttatgtcaaattaaagaatcacgtcgaacattctatgcttataccattaatctccgcaactatttgacggatttggttgaaatttgttacagatatatgtagtttagaaccttagaaaggacatagatatatttttatttcaaaaatcaaaaaataaaaataaaaaataaattatttataaataattctatatcgatcgttacacgacttcggttcatgttattgttttaattcatcgaaaaaaaaagtaaataaatagtaaaaaggtatgaaaaaaataatatcaatataataaaacatttagtacaaagaaaatgctctaacggagtatagataattctatgtcgatcgttacacgacttcggttcatgttattgttttaattcatcgaaaaaaagtaaataaatagtaaaaaggtatgaaaaaaataatatcaatataattaaacttttagtacaaagaaaatgcccgaacggagtataaataaataatccaagttgtctttatcctcgatagatcgaaatagatcgcgctatggtttcgttacattcatttggttgggtatcggccgagcgcttcggtactatcgtagaaaaagtgtattatcagtcgtatgattatttgtctgtagtggtcctgctgtttcgtatattctaaattggtttcgttgtatttgtcaattaataagtttatttgttgggttttcctggttttctggttaaattatttaacgtaggtttagtttgattgatatcgattattagtagttactgtagttagtttttttaataaaattgtaagtctaatttattaattaattagatttaagtcgtttcttttaaattatttagtttaagcttggttattatagcatagaggataggttgtaatataatttcttttttaattgttataaattcgtaattcgtagctttctttagttttaagttagttttcatcttaagttcggaaagattataatatttctttagtttaagtccgtttttaaactatttttttcaatgccctaagtgagtacacatctattaaattcaaacgcagagctcattatgttgatttttgaagagttccctggaatatcttctacatctcatttttagggttccgtagccaaatggcaaaaaacggaacccttatagattcgtcatgtctgtctgtccgtctgtccgtccgtccgtccgtatgtcacagccatttatttccgaaactattgggcctacatagttgaaactttgtaggatgatgtatttcgataaccgctattcgaattttgaataaaaattaataaatttaaaaattaaagggcactccgtacatggaattgattaaaaaaaaaatttttttcagctaacatatccgtgatgggtgtctatggataggtatttaaaaaagacattaaggttcctaaaaccacttttcgttaaaatcaattgtttgaaagttagacgcttccaaagtggaaaaatgagtgtccccccctctaacttttaaaataagagtgtgggaaatctgaaaaaaatatatgctgtaggtttcaatggaaactaacaacgaaaatgggtttgaacgagatatcattattagtttttaagaaataaaaaattttcaaaaaccgcaaatataactttgtcgttcatacaaacactatgtaaaacaaagttattttataacttttataatatgtcatctacttgctgttacggaacccttcatgggcgagtccgactcgcacttggccggtttttgaagagattccgcgagatcgggaactatgtggttaaaaccaaaaatttgccggaagtcactattccacgcgaacgaagtcgcgggcaaaagctagtaaaaaatatatggaaaataaaacttcgacgagacgacgcgacgcaacgcagcgcaaccgtcaagtgtggccggaacctaactgaaataaaacataagaaaaaggcgtatttaggctataatatatctagactatacgttaccgttttccaattttaatatagaagctaatgataatgcaccatagaaccattttacaaagaaccgttttttatccaaatattaaactttcagttcagatttgcatcgacaagggacaaactcttcataatctgcgcattaatatgttctgcggtcgccgcgatatctacgccactgaacacgctgttgcttgcgtacttactagaggctatggtcaactacagcatctttggtgatgctgactccttcatgaagtcgttactgaacttcgccatatacaacgcggctgttggagcggcccttgtggttctctcttacgctgccactactttgatgaacattgctgcttataaccaagtacgtataccaacaaaatgtttatattgtttctcatcttcatcattaatagccagagagtctactgctggactatggggctccgatacatataaagaggggtttgccttaatcaccacacttggcacgcaagttggagatcgcagattaaaaggattaggactatcagacaatgctgctggtctttgttaaatatgtaggttagttgactctcacaatacccgaggaaaactaagggcagtagtagtagtagtacaaatgtttcaagcttaaactaaaattaatcaagagagttgagacccagttctatcattagtcgcctatgtagaggccatattatctgcaactgatatattttaaaaagtcgataagctctcatttttttctgaactttgttatctaatcaaatatctcatacaaggttagcgaagcatatcttcgtgcaacagttttgcatcaatgcatctgataggtaaaattatttcgtacctattcaaatgtttactaattcctttttcacctccaggtatatgtgatacgtcaagagtatttgaaagccgctctaaaccaggactttggatactttgatgttcataaaaatgcagaaatagctaacaaaatgaacaggtacggtttacttaatactaagacatatgtaaataaaataatgaagttactatttgaacaaacgaattatattaacctacgatttggaggaaacttcttaatttctgtgatattgtgatgtgatttggaaaatgtagtttcaaagtgattaaaaaagagaggaaatattttttttttaatgcatgaatagtcactatttgtagcaattgaaaataatttggatctttatcgctcgcagtgatataatgaagctggaagagggtatcggagagaagttagcgaccttcttcttctaccaggcctcgttcttgagcagcgtgatcatggcgctggtcaaaggatggaagcttgctctgctgtgcctcatctccttcccggtcaccatgacccttgtaggcgttgctggattggtgagttctgatattgtatgatatttaattaggtgtttgtactctctgggtaaaatggcaaccctattactaagacttcgccgtgcaactgtcaccaagctgtatctgaaatcatgaaccgtgatagccagacagttgtaaggaaaatggtgataggtttaggtatacactatggaggctccggaacagatctattagaggacccggtgcctcaaacaggtgctgagggttgccagcgggtagttttattgaggttaaaatcccacactccctagtcgtttatccccagaaagctaggggacttttgaaggtttccccccgtcattaaaaaaaaggtttatacactaggattttctcctgtgtccagaaccagtttatcacgtacctatagacctttaaacgatactaaattattatacaattacaatcataaataaagaaataaaactatcatcattgtaatatttgtgtcgcttagatccgcgttaaactgatagttgataccgaaagtcaataaatagatactcgaaaatgataaccgatactatataattagatatatttgtacgtaacttcgactgtatcgaccaatccgtggagtagacacaaaaatattggaatttattaaaaatattggtacaattttaaaatacctgcctaccccttcgggggtaaaagacgtgactatgctttacaattttaaaatatcatgctcaaaaaattaaaaaaaatatgataacttatctcagcttaagaacaagtcgggctttcccgaatttatgttatggtaaacggcaaacacagtggtgcacataatattagggcttatatgcattggcctatatttaaacgagatgatcctgaaatgtatgattcgagaaaattttgtaacttatttactttatcgcaaaaacgatagaaaattttaactctcctttgtaaatggttccgtgtttgattcttaaatacttggatctaaagtaccttactatatatggtatatacgccagttaaaggacaaattttccttaatcacgaacacaaacttgttgttacttatgtcttctgcggttctcccgtaatttaaaatggtgataaataaatatgataaataatacacacacacaacttcacgccttttatcctctaaggggtaggcagaggtgcacattacggcacgtaataccgctatacaatgtacacccacttttcaccattttgtgttaaagtcccatgtaataggggttgataaataataatggtgataaacatttcccaacagatagctgcaagtctgtcaaagaaagaagctatagcgaccggtaaagcaggtgctatagctgaggaggtgatatctgccatccggactgtgtacgccttcagtgggcaggagaaggagctcgacagatacgagggacacctcaatgatgccaggaagatcaatgttaagaagagtaagtgtttcttttaacacattgaaccgttgtgatcaccagtggccgactttagcgaaggatttgccttcaacatttttctattggcagtcaaagacttaacctaaatcttattcagactattttaacaatggacctaatccatggagctaaaaggtacctataaagagcagatgtcataactggatttccctttaaaattatgcgtgacactttacgtggagcgcgggacgttacaaacgacccctctctattttacaacttgcattcctatactacaaacacgctgccaattgtccacattttaatgtggcactttctgacctatctacacctttttacttataatatcattgggcttcccttttgttttgtcagagtgtataaataaataaaaacacacaaaggtcctctacacatcgccaatacatttccaactttattgcgaccaagttaaggttacaaatctattaaacaaagtttacaaaacggtatatcttaatcttctgtagatatgactgacaaaatcttctttcaggtttgttcaacggtctggccatgggttgcctgttcttctgcatattctgcgcgtacgcactctccttctggttcggttacagactgatggtaactgatggatatgatgtttctaccatgattgctgtaagtaaactatttatttcatacgttgttagtttttatggcattcaacattagaagtaaatgcgacaaagggctaaattaacacaatattaccatgttaattttgatatcgtcgacgacttttaaccaactacaaacattatgaacagacagcattcggcgctctgattggttggtttattcgagccagcgaatcagagcgccgaacgcgctctcgtttaaactttaaagcaaactcgtactaagggtacagatagggcagaaacctaataaagtttatttaatccccaggtattcttcggtgtgatgactggttcagccaacttcggtatatcgtcgactctgatggaggtgttcggctcggcccgcggagccggcgctcacatcttcaacatgatcgacaatgtgcccaccattaaccccctacagaacaggggcactgtgcccagtgatattgagggcaacatcgagctgaagaacgttgagttccactacccatccagacctgatgtccctgtaagtacttataaaaagattttagttataaactgtagataaaaaattaggctgagacctttgttcagcagacgtcttctggctgataatgagttttgagactccacccaagctattcctagtgttttgaataattattttaatataaattacataaaactctctcgttggtcgagtggtcgcaagtgcgattgccgggcaaggggtttcggtcttgattaaattaccgggtcgagtaaagtattgctgggcttgtttttgtcaaatagtaattttttcaatagtaccataaagtctggaattacgctcagtatatggcaataccccctattacatggaacctataacacaaatggtgaaaagtggttgtacattatacagtggcattaagtgccgtaatgtgcaggtgcacttttgcctacccctttggcaataaaaggcgtgacgtggcgtaatttgaaatactaagtgcagtacaaattaggatttttattctatttttatttccccctactagtggattttgaaaaccagttcacagtcacgcaaagtgacatcattctcaatacggactatgaagttcaacacgtgagttcaatttaattctaatgccttgttcacactacgttagtattttagtcgagtaacgagtatttagtaactccctcttgctttgattctgagacagaagccggagagaactagttagtatacactcgctactcgacttacggttttgtatgaacaaggcataagtcaaacccagcttttcttaacagaccattgtaaaaagtaatcaacgtttcaacatcaattcttgtatactatggtaataggagtaattgtagaataacactgataatattcatgtaatttgatcgtgtcgataagttacgtgcgacagacagatttaatgttttcattcacgataacacaaaaatgttttaatagcaagcaaattagtcatgcatgtgcgaagtaggtaccttacctaaaatgtaggtaattatacataccgtattgctagtctaccatacataggaaaagataacagagtatactgtaatcgtgcgaaaatttgtgataaattcgtttcttttatcaacattttgttcttacaacattccagaagagttatatgactatataaggcaattaaatataatgcctattcattgtaacaaaatatattatagatgataaattcttcagtccaataatgaacctaaaggaagacatgagcgaatttggaactgtttttacccgactgcgccagaaggagggttatgtttttaatcctacagttcttcaattataattcttattgttatttagtgaacgactagagtatttcaggatttacactttcaacatggatgtcgccgtaaagtacctacttttactcgttataaagcgtcatcctacttttattcattccaccttaaaataataaacaaaacaaattgttgatcgaagcaaaacaattataaaattacaaaaatagggacatatattataatttatcactaaacacgtgttaatttcattcactacgagtgtgatcagagtccaaaaattcgcaactcatgcagataatttgtcctttatttcagctataatctttgtaattcatttactaattttattggcatattatcttgggtaattaccgacatatttattgttttttgacacagacataacatacctatctaaatcaaaaagatgtataaaattcaattcagatgataacaagagcgaagatttcacaagcattattttgtgaacactcgctaatctcctacatagtgaatttcatcatccagatataaaatgaaattatttaatagcccgaaccaattgtccaacacacaaaaaaaaatatttttgtctgacccataaaattaactagaactctaactcggcaatggctcttgatttcttgattattttaataagagcctttagcataacgaaataaaattcatatttgacacgacgcggtgcgaaaataaattcgggcaaagactatgcagacaggttctcttataagatagtcaacattactcattacagttaaatatttcttggaacataacataattattttcctagatccgtatctgttatttgcagaaagtgtaagactcaataccttatcgtttagataagcatgataacctatatgtacttatatggaatttgcagattatgtagttctttctctttaaatgatttatttctattaattaaatacgtttttcgccaacccaggcgtagggcactggaagaaaatatcacaaggagctacccagcttagtagtgttttagacaaatttcattgtaacgcccctctacgcgcgttgtctaatgtggaaacacacacaaatgcaaccctctccatattattaagctaccctccaaacattatatagattttcaaccttattatttcggtaaaataactgaagatcttttaaagaaacatgacgattacagatatttaaatgtgtgagccttaaaaccaaactaaatgataaatcgtttgtccaggtactaaaaggtgtgagtataaaggtgaagcgcggtcagtctgtggccctggtcggccactcaggctgcggcaagtccaccatcatacaactcatctccagattctacgatgtcgtcgaaggaagtgtaagtcgcttttgcaatcgattgtgtttgtctgttcaatatttgcgttaactagatggcgccactagcgaaaaaagtctaatgaccatttttattgaacgttacacttgccaaataaaacatagttcgctgtagactatatatctatgagatttagttgtctacttgttccatagcaaaatatcaaacgaggtacaccaattaggtacttacattaaaaataaaattggaacaaaactccttctaataacttgtaactatggcagtaattcatgagaatgaatgcagaaagtatctaatgatacctattgatatgtcgtcacgtgtactgataaactttagatgttatgtaggtaaaattagaatggctgacgcaatggcgaaaggggtttcgtcgaccattttgtcaataatctgttacacgtgtgtttaatgaaattgatgctctattatgatttttttactgttgtaatctaataaaccgttattgtatctgaccaaataaaattattaaggactacagataccaaaaactctgaccctatatagggatacaccgattttacaattttgaaataggagtcatagaacggaaataatgatttttctgtcttttaaatttcactacaaagtttcgatcttctaattaaataataatccacagtaagccaatctggcaattatattactaaacctccatagagacttatagctattgaaaatgaaactttccaattcaaaatcttagcaagcctccaacatttcttaatccaaaacatttatacataggtcgcaatcgacggtaacgacgtccgcgacctatcagtccgttggctccgcgagcagatcggcctagtaggccaggagcccgtcctattcaacactaccgtccgggagaacattcgctatggacgggagaacgccaccaatgaggagatcgaagcctgcgccagacaagctaatgcacaccagtttatcatgaaactgccgaaggtaggatctatatgttcatcgtcgtgtgacaggatcttcctgtcttataaagaaggatcaaaatcctctatcatttttatcttggtcactataaattttttaaaactcctgacttatgtcgattcatgtcctactatcactttacatataacataagactgatgttctctgcacttcactaagtttttctagaattagaaaatatatgtctacttatttcattcaagaatcaggacctttcttccttactacctttgttccaatttccatacagataggtccaatccttaacacatgatcgtgtaaaaatatccatccacttgtatagatttaaagtagaattaaataatggcagggttacgacacgctggtgggagagcgtggtgcatcactgtcaggtggtcagaaacaacgtatcgccatcgctcgagctctggtacggaacccgaagatattgctactggatgaggctaccagcgccctcgacacctcttctgaagccaaagtacagaaagcacttgataaggtaatattttagcactttacttctaggttttgttattttttcaaaattaaatacgtactaataaaatttattcagtaataccctgaagcagccagtcaacaagaatagtttagttaaatatttgttaatattttactactcgactagtctcaaacctaactggagcccttaattaactccacattagtccagcatgtccatttttatatgttgtgtgcacactgatgttgaacccacaatacatacccatataacatttatgtttaattccattataaaattaaattatccatcttacaggcacaagaaggtcgcacgacaatagtggtggctcacagactgtccacaatcaggaacgtcgatgtcatatacgtgttcaaggctggtttggtggtggaatgtggcaaccatacagaactgatggcaagcaagggacactactacgatatggtgatgctgcagaacctgcctggcgtggatgagcagtcgcctggtaatttctaaatacactttctattatctcattcatgatttgtgcttttgtagatgatagacatacctactattactataaaggtttacaaaaagacctttgttctttgcgaggcagaagaacaaaatccctcactttgagtaaacttgatgttgatattttgcagaaaaaactaaattgtctcgcgagacttctataatcagtgagaaggatgacgaagacgagttcttggaattccggaatgatgtaagtattctttagttatttaaccaacatcatcatgtcagctacgcagacgttcacgctattagaacaaagaattgagatgtattctctttgaagttctatcattagaaggtacacttgtagacttcttattttaaagtgattagtgtttaagtgtttcaatcaagttaaatgaaatcatcggcggatcaaggaaatattactgacattttcaataatagaagctctaagcagtaacacggagactagaaatcccattttaaatggggttcatagcataactatcgaaaagtgaatactatattgaatatgaccacattaaacaatcaataatgtgacctaatgctttttggatattaagtatgtttttctgtgtccaggacaaagaagaggacgctgccgaagctcctgacatttccttcatgagagtgttgaagctgaacaagccggagtggaagtctgtcaccctcgccagcatctgttctctcatgagcggcttctgcatgccactgttcgctgtcatctttggagacttccttgcggtaagatatactttgagaaggaacggggtggtttttagtcagtaagagtctgacactccctctcgcctcgcccaagatgggagaagtcattgatattaccgctcaaaaaaaaaaaaaagatatactttactcactccgtcaaccgtacgctagtttaccgacttatctttatatatataattcttctgtaagtgtgtatgtcactgaacttctcttaaacgactggaccgattttgatgaatttttttgtgtgtgttcaaggggatctgagaatggtttagattcacaattttgtccgctggacaatgttttttttaatttattacgtgtagacaggacaacgtctgtcgggtccgctagtctcatataaaatgccagcttatcttttaaaaaaacgcttaacaggtagatgtggattggagatcgtagtttaaaaggattagggttatccgaggactctgctgcccggtctctgttggaaatctgcgggaagaataagggtaccaatttaaaagtttcgtgtctttttcagttacttgatggcgacgatcctgatgaaattcaaaaaggagtgtcacgattggcgttgatctttgtcggcatcggagtgttctctggcatcactaacttcattgtggtacgttactacacatttaataataataataataagtccgcaaggcagcttgtggcggtccgcaaggcagcttgtggcggtccgcaaggcagcttgtggcgagctgttgggcagtggcgaccccacggacctgactcccgggagaggccctactttttaactccggttagtactcgtgactatccggagtggcctctcctacctcactcttgccttaatcggctggtttgagtggagattcgcaagagtggagttgccttcagctccacttgggggaaggacgtatcccagtaagatgctggtaggggtcttgaccgtacttccgggattgctctgatagccgtgggatgcctccccttcctcaagcagctcaacggatgttgcttcccttgtcgctacatgctagcggccgtttccgggggcccactattgagtttgcgagtcaccccctgcctgtttatccgtatttttcaatattggtcaggggcaggggccatagtccccatagttaaccggttaactattccacagccacccacacccatatccctatcatttccttttaccatatctcacaatagtcctgcatcaaccggggattgtcctttggtgtacttccatagtgcatccagggataatcgccggctgatgtcccattacatttagattaaaattgttcaacgggcctctgcgagttggcttcggcccctcgcacgccttccaaaggtccgggaccctgtggtcccgtgattatgtaatgaacatacataataataataatatatttatttgccagaaacacggtaaatacagttgttacataaatatttaaaagagatcaacatgtttcgctgtcgtagcagcatgcaaattatccaagttattttacttgaaaacttatacactaaactaataaagtaatacattgtagttaactcaatgacttaggtaatacataatacatacgcattttaagtacaggcataaaggcgaattaaataattacattttttattttgtacccaaaggacttacacttatttttcacaaaatattcatctatagaataataattttcttttattagccattcctttagagcagtacagaattttttataggggagatcacttatagacttaggtaacgtattgtatataaggggagccatatagacacaactacgcctaaatagttccagtttaggtgcaggcatctcgagatgcctccatgttacttttcttttatttctgttgtctttggcttcaaagagtgagagattagatcttaaaaattttgcaatctcatagatataaatacaagttaccgtcaacagcttattagaacgaaatataggcctgcaagattcagaccaattcaaattaaatattgcacgtatacactttttttgggctattaaaactcttgaaatttctgtggagtttccccaaacaataattccgtatcgaatgattgagcagatataagcgtggtaaacaagaagagctgtatgtgtggatgtgatttccttaacttttcttaaagcaaacacaaacctattaatcttattacaaacactatctatgtgatttttccacgttaggtgttcatcgaggataaccccaagaaatcttgcactgtgaacctgttcaatcatttgaccattatattgtatatttaaatgcataggcttacttcgacaggttttaaattttaatatattcgtttttgatacatttaattttagcttattgttatctaaccacttagtgatatcacctaatgtttgatttacaatagtatcatagttttgtgggcctttgaattctatgattactgtagtatcatctgcgaagagaacacaccgatgtttgataacttgtggcagatcatttacatagattagaaatagtaatggtcccagaatgctaccttgtggcacaccacagaggtttattagaggcttagagtcaaagtcttctagtgtattatttgcgtcattaagttttgtaactctggttatttgttgcctattacttaaataagactcaaaccattttagagctgcacctctgattccgtatctttccatttttgctattaatctagaatggtccacaagatcgaaagctttagttagatccaaaaacaaagcacaagtagatgtagaagagttcatattattcattactgttgtaattaacgagtgtatggctaacgttgtagatttattctgttgaaatccaaactgttcttttacaaggatattatacttatttaaatattttaacactcttttaaacataactttttcaaatatcttagataatattggagttaaggctatgggtcgataattattaacgtcaaatttggacccttttttgtgtagcggttttatcagagacagtttgagtctgtcaggaaagcaaccttgttcaaaagacaaattgatgatatgtgctagtggtggtgatatatactgagctatacatttggttatatctgttgatatgttatcataaccacatgattttgtgttctttagatttttaataatgcgaaagatttcatcattatcagtgggttcaataaaaatactattattatgtaaatctacaccaatattatttaggttactatttttgtcggtactattgttagccacatcaatgaaaaatttgttaaatttatttgcgagttctgaacctaacgtaattgtagtgtcattttctttaaggacgtttatacattctctacctttcaaattacccatattgtgctttacaacgttccaagtagctttaactttattatgagaacgagctatgtgtctctgattgcccatgacttgaaggttattcatacaatttcttaatattttggaatattttttatacctatttttattttcattattcctatttagatagtaactaaaccgcaaagatctcttttttttactacttatttttattccctttgttatccattttggtttgttaaagttatgtcctttttttactctaatattcggaaaacatagtttatggaataatattaataggtcatgaaatttatcaaaagcttcattggtatcggtcgtttgaagaacttcgttaatagtccagtcatttggtagttttacctggaaagttttccgggagttttgaaaattggtgaatttatagatttgggtatgctcttttcgaatttcaactttgccacctcgtacaaccgccgctcgcgccgccatattgaaaaaatggcgcctaaaaacggttttttattaatatctccgttccgacgcattttacgaaaaaatatttatctacaaaattaaactagaaaaaatttcctacaatttatgtattgataactttttcataaaatcaatagtttttggcgtacgagcgccgcaaagtattatttatctgcaccaccacgtgtacaaaaaatgtgtgttgtgtagcaacgactgtcgcaaccgagggctgggctcgctgtcattgcagaggtaagtcccctgtttgaggagtggctagagaggcgccatggcgtcctcacctaccgcctgacgcaggtgcttaccggacacagaaatttcggtagtatcctgtttttgattgggcgggaggaaacgcccgggtgtcatcactgcgaagaccgcccggaggacacggtggaacatataacataacacatataacatcagaaacaggaacctaccgaaactaacctgtttgtacaacacacattgtttgtaaacggttttttattaatatctctgttccgacgcattttacgaaaaaatatttatctacaaaattaaactagaaaaaatttcctacaatttatgtattgataactttttcataaaatcaatagtttttggcgtacgagcgccgcaaagtattattcatctgcaccaccacgtgtacaaacaatgtgttttttttaaatgtatcaattcttaaaaactaattatgatatctcgttcaaaccaattttctttgaaagtttccattaaaatctacagcatatattttttttagttttcttactcacttattttaaaagttagagggcaggacacattcgatagacctcatttttccactttggaagtgtctatctttcaaacaattgattttgacgaaaaatggttttaggaaccatgacgtatttttaatggcctatccatagacaaccatcaaggatatgttagacgaaaaaaaaatttttgaagaggtgtagtgaccgcgcgctctcccccctctatctcagaaacggtgcaccgtataaaaaaaaagtttacacaaaagttgtagagaattttgtattctacaatattggtattaaatgcaaataccaaaaacccataggaaatgagatatttccaaaaaagcgcaaagaaacgttttttgggacctttggaccttaaaatttaatagttgcttacaccctaccatatgtaggttttgagacaagtttcaggcagtcaatatacaagtatatacaaaattacagctgggtatctcaaattccgaggtgaaatcctaatttgactggactaataatactttgcggcgctcgtacgccaaaaactattgattttatgaaaaagttatcaatacataaattgtaggaaattatttctagtttaattttgtagataaatattttttcgtaaaatgtgttggaacggagatattaataaaaaaccgtttttaggcgccattttttcaatatggcggcgcaagcggcgggtgtacgaggtggcaaagttgaaattcgaaaagagcatacccaaatctataaattcaccaattttcaaaactcccggaaaacattccaggtaaccccctttttatctaccaaatgactggactataaagctaaggcaaccaatatagtctacaaacttagttacattttccttacttaggtcatttataaccgtgaaatagtaatggtttacatcaatagtgttttcttttattgtaactgtttgagccgtgttatgatctgagagataaagatgatgagtttcacccacaccttcatctatattaccaatgatgttgtcgatacatttgttattcctagtaggttcatttatgtaatgttttataccataattaagcattaagtctctaaaagtcctactatttttatcagacaataataaatctatattaaaatctccacaaataattacattttgttttttaatctgaagccttaaaagaattttctcaagattaacaaaaaatacgtttatatcagagttcggggttctatatatacagagtactataagtttgagtttttttattacaataccagatatctcaaaatgtttttctgttgcatattcctttataatatcaagtttagtactttcatatgaattattacacagtatacaagaacctccgcggcgttgatcttcacgagaaaaaatatccgcaaggtaaaacccgctaatattaaggtaccgttcctcgtgttttttgataaaatgctcactcagacataacacaacaatatttttctttaaatcatgcaactctagcagtgctatttctaggtcctgcattttatttaaagcacccgcaatgttttgatgaaatacagtgtaagaagacttatttacgaaaaaaaatatttttatttgattctacccgtgctactacatctgtagtaggatttgttttcgatgcatcgtgcgacatttttttaataatgggaaaataataaggaattgtacctttttttatttctacatgactactaattttttgtgagacatgggaattattagtaattgatgaatttcgagatcttgtaagcgtgagaccattataagataggaatgtttcattatataggttaacgttaatatgatgcattattttttgtataacattgtgtgttctcgcctctacaaatgtacaatttttaaaattacgtgttattaacttcaactcatagtttagtttagattcgttaaggtaattattatttagaacatttattacatacacattacaaactttaagatagtgtagagctatagaaatttcagtcataaactcgactggattagtgtcattgctcccagtcattataattacatgatcctttttcgagagtaaattagtgtaattactacaacctgccaatacatgttttgttttagcatttggttttgtcatggactctactttataatcatcggtaattagtttatgcttgttttttattagtgtttgtacaatacctaatccttgattatctgagaacataagtattctacctgattcttcatgacattttccatggttgagttgactaaaattagtagtattcttccttgagccgcagcgtggacgaacggatgtattccttgactcgcagcgtggaggaacggatgtattccttgactcggggctcggaggaacggatgtattcccgtcgataagcatgacgggattagcttgaccaatagtggtttccggattgtccctgctttcagtagattctattggggtgttgttgcgacaaagcttaggagtttgaaactccaagtccaggtttagtctccttgaggagaattttggttttatagcctgacttctttttaattctatggaggttgatgacgatgcggtttttttgtgacttaacgtagtgcacatcattttaagttgctcagaattttttgctttattttggagctgtgtcttcatttcataattttccaaggttagtttttctatttcagtatgagcacttaatagttcttccctcaatttttgtatcaatctttttagttgcgttacttcatcactgctgatgtgggtagataggtccatcatactcttaacgcttagattattagatgttgtagaatcgagtgaatccaaagaagcattcgagaggcatctcctaatgcatcggtttctcacagttatattatttggttccatttttatgaatatagaactttgaaaacgttaatgctataattccaattaattttgtatcttgatatggaacgtttcttggtatgtttaacatcgacaaaccatgttcatggaacgctcgaccgctcgtgtcgattgacagcgttggcaataccagactggaacgcgaacgagcttcattcaagttcgttcggttggtagtaccgccaattttaaagtttggaggtaaaaacagaaaaatgttttaaaagtctaatatttcactattactgagcacttttatctttattttcaccacactttgtagtccatttgagaaattgtattgtttgtaccttgagcagtggaataattaattatttctaacattaactgcactgtactatgaaacattgaagtaaagttttttattaattaacagttattatagcacctgcaaacgatatcactgtattattattgtatttggaactcacagatactatttatattgtatttacacacttaattctgcaaatttacaaatttaaatacggagccaatgtttacattggctggggttgccagcttttttttttttcatttgtataataggtattcatattccctaaaatattacaatataaatctattcaaaacccttggtaagtcagacttagtagatataagtaactcctaatttcctaatgaaagagtttaaattctaaagcctttttattataaaaacgttgccccacattaggatttcctcctgtgtcgtgggtgcgttttcaaacatacaatttcacacacatcccacccacacccgcaacaacaaactgtggatcacacaaagagttgttccgtgcggatatcgaacccgtgccacgttgcacggcaacctggggccttagtctgctattacaattatgcctacatagctccgtccctctcgcactgctcagtgatcgaccattctgacacaattgtaatagcagactaaggccccagttgcccagccaccgcactaactgtgcagtcgaagtcttttgtctttagttaaaccatcactgttgaactcaacaattccaggtattcttctacggaatagcgggtgaagcgttgaccaagcggctgcggctgatgatgttcaggaagctgctggagatggacatcgggttctacgacgacaaggacaactccaccggagcactctgcgcccgactgtccggggaggccgccgccgtgcaaggggtgaggacttctggtcattctattgaaagatagagcttgagctgatggtaagcaatcgccgccggccatgaaaacccgaaaccccttaagaatttaagggttgttggggaatcgggaattgggaagattgggtagggaggtaattggacctccggtaatctcactcgacttaatacaacgcatgcgttgtttcccgtcggtattctatgaggccgtgatatcactccggtcgagccggcctattcgtgccgaagcatagctgtcccacacttctacgagtatctctatttattttctaatctaccgtcacgacactgctgataaaaataaatccaacattataataaccggagaatcttctaccttccaccaggctacaggtcaaagaatcggtacagtggtacaggcagttggtacattcggcttcgcgctggtactgtccctgatcttcgagtggcgagtgggtctggtggccctgaccttcgtgcccatcatcatcttcgtgctgtacaaggagggcaggatgacttacgccgctacttctggcaccgtcaaggtcatggagactagttctaaggtaaaataccaaaatgcttttgtatagattggggagagagagatatgctctccggctttaaaaaaaaaatagtcaaataatgtttgactgcaccgttggtgcggtggctggacacgtgtaacgggttagattcccgcacggagcaactccttgtatgatccacaaattgttgtttaattagtaaatcccaatgaaacacttcctctggtctttgataaaaatcaaatatttttgataaatacaatgtgataggggcgagacttctaacccgttaaggctgagttctacatctaattttatcgacaaaagtcgggggtcgaaggggtcgaatcccctccccctaaaacttatggctattttaatatttttttttactttttttgatatcaaaggttgtatgcgtcgtagaaacaaaaaataaacgacaaacggtagctaataaccttggctaactaattcgttacttttttcatatgtttgataatgttttggtgagaaaaaaaatcatttgtgaattatttttaccgaaaaaatcactattttccaatattttcaattaggggttcaacaccccatattatttttttgtcgataaaattagatgtagtactcagccttaacgggttagaagtcccacgcctatcacattgtataaatatctgctgtctaatctctgttaagtttgtaatcgcttagtcagctcttacgacttgcgagaagaatagaaaatcctcccttttctatcacgaaatggtattacagatagccgtagaagccgtggccaacgtccggacagtagcgtccctgggtcgcgaggagacgttccgtcgcgagtactcgaagcagctgcggccggcgctggacacggccgtgcggtcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtaagttttatggactatttgtgtggcaaagtagaagattttattttgttccctgtttttattatgttgttatgtaaaaaagataatttggtttactactttcaaaataatgcatcacaataggaacctatattgtcttacctagtgtgttaaccacaaaggatatgtaaaattagtaacagatttttttttttatatgttacgatttatggctcaatctggaaattgttttcattttcgacgtaactcgaccattttcaagtcatgcttggagctcactcgtgagcagctttgcgcaaaacttttttttagataactaagaatattttattacaaaaaggttttctttcaacatttctgaccgcagacgatcatttagctttatatctaatcctcgtttaggtcagctcaagccctattgatgggtgctacgtcagcggcgcaggcgtttgcgttcgcccccaacttccagaagggcatcaaggcagcaggccgtgtcatcgttctactgggcagacagtccaagatcacggacccagtggaacctgctgtcaaacacttcgtgagtttatatttatctccgtccgtctaaacaagtgcgagtcggactcgcccatgaagggttccgtagcagcaagtagatgacataatataaaagttttaaaataacttggttttacatagtgtttgtatgaacgacaaagttaccgtatatttgcggtttttgaaaatgttttatttcttgaaaactaataatgatatctggttcaaaccaattttcgttgttagtttctattaaaatctacagcatatttttttcagttttctcactctcttattttaaaagttagagggggagggacactcatttttccactttggaagcgtctaactttctaacgattgttaaaattttttttttgaatcacgtccatgtatggagttttttaaaaataatttttaaatttatttatttttattcaaaattcgaatagcggttaacgatatacatcatcctacaaagtttcaactatgtagacccaacagtttcggaaataaatggctgtgacatacggacggacagacagacatgacgaatctataagggttccgttttttgccatttggctacggaaccctaaaaagggtttcctttctggcgttataactccagaacgcatgaacagatttccacggttttgaaaagtttcgggctccgtgaggtatatagcaaagaaaattcaggaaaaaatcaagaaaaacagggaaaatcattggcggaacggagttcgccgggtttactagttcccaattaaaacatgtgaactgtaatatttttgcggtaacttctacaaagtggaaactgatacattgtctttatttacattattttctcttttacttactatttactcgtttcgtacagaacggtacaggagaagcgagtctgcagggcattcagttcaggtacccgacccggcctctggtgcgcgtactgaaggacctgaacctggagatacagcgcgggaagaccgtggcgctggtgggggccagcggctgcgggaagagcaccgtcatacaactgctcgagaggtactacgatcctgaagacggcattgtggtgagttactagcagcaagtagttaggacttcatttaataattaaatttaataaagaaattaggactttctttttaaatgcggtttacgagaactccggatgatttggtaaatgggttcacgacacgatacagggcgaggataatagcaaaaatgcaagcctaaactgatgaacgacctcacgataactagaaattttaatcccaaaaaaaaaatagctttgacatatagtaaaacaaagtagatatataagaagtctttaaactgacatggacactagtaatatcattagaacttaaaacgggatatttaaagttctaatgatattacaaagatattagatattttgtgagcccttagtatttttagcaccttgacaatattccttaaagacgttaatcataagcatctatgacacacaggctcaagacggcatcccgctaccgaagctgaacctagtagacgctcgacgcgcgatcggcttcgtgcagcaagagccgatcctgttcgaccgcaccatcggcgagaacatcgcgtacgggaacaacgaggcgcgcgtctccaacgacgaggtcatcgaggcagccaagcaggccaacatacacaactttatcacttcactgcctttggtaagtgctcgtatattatatatcattatctatgtcattatgatcttcatgatggaggagaaggatctgtcaggatggtattttgaatcacaaactccaactgcatttttcttctttattttgcctactgaggaaaattttcccaagctataaactcatcactttctttagacaatgtttatttcttatgtaatccttaggaagcctatatctcatttggacctttttgtgcgcggcaggacgtgaccaatatacttttctttgcaagaagatggtaatcttctttgagatgactcagttcctagtattagcgctcttgagctcaaattaccacgtgttggatgtacctactaataactaaatgttctacttcaacagggttacgacacaaacatcggatctaaaggcacgcagctatcaggtggacagaagcagagagtggccatcgcgcgcgctctcatacggagacccaagatgttactgctggacgaagccaccagcgcactcgatactgagagcgagaaggtatgtccaactcatgtttttttataagaaaaggggtaaatgagctgagctgcgagcgtacctagtgggcttaccgggactccggctcgaaaagcaggagtaagtacggggtggtttttagtcagtgagagtctgacactccctctcgcgtcgctcaagg

SEQ ID NO: 343 - DNA, 5596 bp, Spodoptera frugiperda;
agcaatctgcactgcccatggacatacatcagaggagttctgtactagtgaagaattcttcggggaatggggattaggggatgggtagatgattcttggtagccttacttacgcctacaattcctctttaaaccacactcacacaacacaagcgttgtatcacgccagcttttttgtgaagccgctgtagatactccggcggaaccggcccattcgtgaaacatggttctctacataagtttttaaactgacatggtcactaacactagaagtgaaatttataacgggatatttaccatgttttcatgaaaaacatggtaaatatcccgttataaatttcaattctaatggttctctacgcttaaaggcattttaagaacattgtatattttctcttgcaggtggtacaagaagcattagataaagctaaagcaggccgtacgtgtgtgatgatagctcatagactcagtacagttagggacgctgacgtcatctgcgtcatccacgaaggacaggtcgcagaaatggggacacataacgaactactcgaacttaaaggactgtactacaacttaaataggagaggatacgcttaagttatgtagttttatgtctttaggagtaattacttattatggatggttagtcaaacagtctctcagcgctttgcaggctcggagaccaccgaaaatttagaggatgcctcttgcacttgcgatgtttataattctgatgtacctacttatgtttcgaccgctgaacataaccccgtcatgtgtgtacctattatgttttataaaacactgcttcgcccaagaagtcttgggttcaatttgaatcacaactttttccactataagtaagtacatacttaattacttaagccaaaaagtttggcggtgcctgtatataaaacttaacttgtataaattcagcttcgaaagctgcaataagtattttctaagaaagtataaatattaattatgggcctattaattattttacaatgtctgattaagtcactgctagcctaacgaaccgattaaattattattatttacattccatatgggaaataaaattatccgtcaattgtatgtgaacttgtatgtccgtaaacggacccacgacacatgaaaaaatgctagtgtggggcaacattaaaaataagttaagctaacagccacttaatcaacctgacccagtaatcaataagtattctaataaattgtgtattataattgtattaattaagtttaaaatatattttgagacatattttatttaattaatgcttacttttataagtaagctgcgaacacttgaataaaatcaacacttaaagaaacagacaaaggatagtattaggatattatggcatttaatacttataatgatatttaatgtgatatgaaaactacattacctacgtatacagttatacatataggtattttaagtaacagtgatatgcctaggatgcctttaatgtagttacctacctatgtactgtattacaatgatacctatgaaataataatataaattaaaacaattacataattatttaatgtgttgtacaaacctataggtatgtaggtttataataaaaatctttacaataccgacaatattacattaagtatggtaaataattaaataaaaaagttgtgcctatggttaatgtgcctctactttactgaatcaaattatatctagaccacagtaattatactaaagcaaccagtgataatgatttagatttgtttatttttgtaatttatttatgacaataggaaataaaattatattttttgttataaaaatgtttttcgttttatttttgtcaccctgaattattcttgcgttttctcaaacccaattttaataaaaaacgatttcttagaaagtgcacaagacggaacaaagaaaacagagtcacaataatttaaagattgtattgtttcatttaatacttagaaaccagtaaatcactttaaaacaaataatgagtaagttgcgtagtatatggggacacaaatgacccctaataaataactaggtacagtgcgtgcctccatgatttacagctgtttgttctttccacacaaaacaagctgttacagtattgttttcctttcattgcattacaaaactttgaccaactattgtccagttttattgcaagagatctacttttatattatggatgaaatttggtgtctgtgtatatttttgtttcatattatggtaagtatatttgttagttaagtaggtaaatggatattccgtaatatctaacacaataaataaagcgataggtacatagtgacaagtcccgcatggaaacaatgtttgaaaaattcccagtacaattcccatcaaagagcaattaataaaaattactcgtttcataaaacaattaacgtccagcggagcgcccgcgcctgcggtcatctgatcggaatcatctccacgagccgccataaattcattgttttattatgtcacatccccgatgttataaaaaaccgacaaattactaaattgagacatcccgctatctgccttatagacacgtgaagctctttaacgaataacacccatcataacataaaatagatcctatcgaaaaaccaatatgaccgagcctccatttttttccaccccagcgtgagctttatgctaatgaaacccaaaaacaaacattgttataagccaaatgtgtaacatacgataaaaataaattaaataataaagggaatcgttaaaatggaagaaatgtccgtaatttatccacgagtcaccttttaggcattccatggatgccatcgcgacggggtcccgcgagcccgcctgctctagacgcgatctccaaataaaaaggcgccacaaaaagacgtattcaataagccgttggccattaccggacgtaatcgatgagataaattagttataataaaatctgtggagctgtagacggccgtagtaggtacggccgtcgaatgtctgagcagccccagagacgtgcatgggtcgtcatagtttgtagtaagtaactactacaaaaacgaatgcttgtctatattaggtgtaggtctctaggtacttttcttgctgcaaaaaccatttgcagcaagaaaagtagaagtaataaactaggtatctgtagttggtaattgaagttgataattacccaggccacgtaagtaactcgagataatttgttaatcgtgtggtttgtgtagttcattatgcagtattcaaacgcgtatgagtcggggacatgcagtgttgagtgtagtgaaaacgcacaaacgcgtcgcggtcaccgagtgttgaaacctaagaaaaaataccaggaccacattataaggctggaggtgagtttattttgtataaagtgatcgttgaattcttttttatggtataaacgcacatgtgaatctgttgcacagtgtgtagtattctatgaccgtgtactgtagtgaaaacgcacaaacgcgtcgcgggcactgagtgttcaaacttggcacaagcaccagtgtcgcataataatatggcaagagatgagttgactagttcataattttgtatctacaaatccgcgtttaagataaaccactgaccgtatcttctcttcttagctgtcagagatcactcttgacagagtggtcgtgcggctcgtgcgtggttaacacgtgatgggtccgatctgtcttattttgttccgccgtcttagtgcactcatgcaaagacatacctatagttacctacccaacgagagggactgggattccgtctcctctttctgcgaagcagtcatgctagctaaggaggcggggcgcgtgagaacaaacctcctcacaccctagccgtcgcgagacacactccgggcgtcggggatcgcgcgacgatcttcggccaaaagtgcgggcctgcggacggcgagcaagggtagctcaccgcccgaacagaaccagacccgtgcgtgcggtgggtcgcgttccgcgcgcgcctcaaagagccatcagatcaccacagatggggcccagcagagctgatgcctgatccggagctgcggactacctcgcggcagttcaaactcttgagtaggaaatgcaatctcgatccctagtttattttgagcgacattaaactaggtaaaaaaatggacgagatctcgcgcgattatgtacagatttttttacttatctttgtttgatattgagatggctggttgtttctttcatttgatatttattatgtacatacgtcaaagtagaagtagtaaagaatcaaaattgtaaaaaaaaattgcttctacctccaacttcgtctggccaccacattgcctttaggtaaaatcttttgttccaatttccgagaaaaaaatcgtgaatatactcgtaaatcatttatctttaaatctcattgtttttcaaaaatatgattattttaaaaaaatatacgaaattgtcaaattgcaattgccaaatgtcaaaatggttacaaagtgagtggatataaaaagaaaaacaaaatgattctgtttcttaatttttattggtaaattcacattcaaataatagatcacgtcgaagacagatattacaatatgggatctctactgataaaatttagtaattatttgctatgatactgtatcggtacttttcaatttctaaatctactgctccattagctacatcgattttagagtgcgtaaatgcttcaaaattccagtgtcatgagtgagttcagctatgagaccttcaggaaaatagaaaatcgaaaatacacaattacattgttcacttacgaattcacgatacagatcggacatcaaaaatatttctatattaataaactactttcacataatcgttactaaaaaagacaaaacgcgtgcgagtcacgtcgcgcgtgacgcaaacgatacatgtgatcaaatttaatctaatcgattacttcattaatgatcgcgaactaccattctcgcggaatatattcacagacatttgttaagcatgcccatggtgatagtatgaagttaagaaacaaggcccggccggaccaccgggcagcgcacctgagattcagcgcccgcagccggccgcgcccaaacacatctctctgtcgcaccgctctcttctattgtacaaacattaccgtattaaatagtcacaggtcaatttcagtccaactatcagtttacgaattaaaataaaatatattaatctagaacgtttcacatcgcttaagttacgaatgaaggggtcgagtacggggtcgcgtgcggtgcgaggtctgcgggagtgcgagcggacgctttacgagtcccaccagtcggggccgccgctgctgccgccgccgccgccgccgccgtacgacccgccgtagttaccgccgtacgacccgcccccgtatccgaaccctgcaacataaaacggtcagttaggaaacatctttttttacaacgtctttgcacattttaatgccataatactgaccagaaccaatagtagacggtcctgccgatcgtggagtctgacgcgattgagtacggaaatctcttgcgccaaagccactgccg

SEQ ID NO: 344 - DNA, 3786 bp, Spodoptera frugiperda;
atgaaggactcgaagggaaacgcgtggcaattgaaaccaggggaaaaggagaacgagaataaattaccagacccattgaatgaagatgtacagaaaggacaattctctgacacgagttcagaaccatctgaagccaaggctgaggaagtaccaagtataccttttatcacactattcagatttgcatcgacaagggacaaactcttcataatctgcgcattaatatgttctgcggtcgccgcgatatctacgccactgaacacgctgttgcttgcgtacttactagaggctatggtcaactacagcatctttggtgatgctgactccttcatgaagtcgttactgaacttcgccatatacaacgcggctgttggagcggcccttgtggttctctcttacgctgccactactttgatgaacattgctgcttataaccaagtatatgtgatacgtcaagagtatttgaaagccgctctaaaccaggactttggatactttgatgttcataaaaatgcagaaatagctaacaaaatgaacagtgatataatgaagctggaagagggtatcggagagaagttagcgaccttcttcttctaccaggcctcgttcttgagcagcgtgatcatggcgctggtcaaaggatggaagcttgctctgctgtgcctcatctccttcccggtcaccatgacccttgtaggcgttgctggattgatagctgcaagtctgtcaaagaaagaagctatagcgaccggtaaagcaggtgctatagctgaggaggtgatatctgccatccggactgtgtacgccttcagtgggcaggagaaggagctcgacagatacgagggacacctcaatgatgccaggaagatcaatgttaagaagagtttgttcaacggtctggccatgggttgcctgttcttctgcatattctgcgcgtacgcactctccttctggttcggttacagactgatggtaactgatggatatgatgtttctaccatgattgctgtattcttcggtgtgatgactggttcagccaacttcggtatatcgtcgactctgatggaggtgttcggctcggcccgcggagccggcgctcacatcttcaacatgatcgacaatgtgcccaccattaaccccctacagaacaggggcactgtgcccagtgatattgagggcaacatcgagctgaagaacgttgagttccactacccatccagacctgatgtccctgtactaaaaggtgtgagtataaaggtgaagcgcggtcagtctgtggccctggtcggccactcaggctgcggcaagtccaccatcatacaactcatctccagattctacgatgtcgtcgaaggaagtgtcgcaatcgacggtaacgacgtccgcgacctatcagtccgttggctccgcgagcagatcggcctagtaggccaggagcccgtcctattcaacactaccgtccgggagaacattcgctatggacgggagaacgccaccaatgaggagatcgaagcctgcgccagacaagctaatgcacaccagtttatcatgaaactgccgaagggttacgacacgctggtgggagagcgtggtgcatcactgtcaggtggtcagaaacaacgtatcgccatcgctcgagctctggtacggaacccgaagatattgctactggatgaggctaccagcgccctcgacacctcttctgaagccaaagtacagaaagcacttgataaggcacaagaaggtcgcacgacaatagtggtggctcacagactgtccacaatcaggaacgtcgatgtcatatacgtgttcaaggctggtttggtggtggaatgtggcaaccatacagaactgatggcaagcaagggacactactacgatatggtgatgctgcagaacctgcctggcgtggatgagcagtcgcctgaaaaaactaaattgtctcgcgagacttctataatcagtgagaaggatgacgaagacgagttcttggaattccggaatgatgacaaagaagaggacgctgccgaagctcctgacatttccttcatgagagtgttgaagctgaacaagccggagtggaagtctgtcaccctcgccagcatctgttctctcatgagcggcttctgcatgccactgttcgctgtcatctttggagacttccttgcgttacttgatggcgacgatcctgatgaaattcaaaaaggagtgtcacgattggcgttgatctttgtcggcatcggagtgttctctggcatcactaacttcattgtggtattcttctacggaatagcgggtgaagcgttgaccaagcggctgcggctgatgatgttcaggaagctgctggagatggacatcgggttctacgacgacaaggacaactccaccggagcactctgcgcccgactgtccggggaggccgccgccgtgcaaggggctacaggtcaaagaatcggtacagtggtacaggcagttggtacattcggcttcgcgctggtactgtccctgatcttcgagtggcgagtgggtctggtggccctgaccttcgtgcccatcatcatcttcgtgctgtacaaggagggcaggatgacttacgccgctacttctggcaccgtcaaggtcatggagactagttctaagatagccgtagaagccgtggccaacgtccggacagtagcgtccctgggtcgcgaggagacgttccgtcgcgagtactcgaagcagctgcggccggcgctggacacggccgtgcggtcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagccctattgatgggtgctacgtcagcggcgcaggcgtttgcgttcgcccccaacttccagaagggcatcaaggcagcaggccgtgtcatcgttctactgggcagacagtccaagatcacggacccagtggaacctgctgtcaaacacttcaacggtacaggagaagcgagtctgcagggcattcagttcaggtacccgacccggcctctggtgcgcgtactgaaggacctgaacctggagatacagcgcgggaagaccgtggcgctggtgggggccagcggctgcgggaagagcaccgtcatacaactgctcgagaggtactacgatcctgaagacggcattgtggctcaagacggcatcccgctaccgaagctgaacctagtagacgctcgacgcgcgatcggcttcgtgcagcaagagccgatcctgttcgaccgcaccatcggcgagaacatcgcgtacgggaacaacgaggcgcgcgtctccaacgacgaggtcatcgaggcagccaagcaggccaacatacacaactttatcacttcactgcctttgggttacgacacaaacatcggatctaaaggcacgcagctatcaggtggacagaagcagagagtggccatcgcgcgcgctctcatacggagacccaagatgttactgctggacgaagccaccagcgcactcgatactgagagcgagaaggtggtacaagaagcattagataaagctaaagcaggccgtacgtgtgtgatgatagctcatagactcagtacagttagggacgctgacgtcatctgcgtcatccacgaaggacaggtcgcagaaatggggacacataacgaactactcgaacttaaaggactgtactacaacttaaataggagaggatacgcttaa

SEQ ID NO: 345 - DNA, 1930 bp, Spodoptera frugiperda;
gatcattaagacccgccagagctgcgtaaaacaaacaaactttcgcgttatttcgcgccgactttcaaactatttgtagcttttcacgcttcaagggaacttgtcggccattgacgcacttacactgttctaaaccaaacgttgtattataatcgagtttcagttctacagcacctttcacgttttatcgacctgataaattgataacgtatcatggatgcgttagtcgcgattgggaggaccgcggataaacgtttcagccgatatatacggctgacttaattcatagtgaattagtataatgagtttttaaacacagtagctgtctgtagttgtggtgtggcctgttgttgtgtgaataattcagttaattaattgttcaaaatgaaggactcgaagggaaacgcgtggcaattgaaaccgggggaaaaggagaacgagaataaattaccagacccattaaatgaagatgtacagaaagggcaattctctgacacgtaagtttaccttgtatattacatattattatttgtacgcatgtaaacaatctgttgattgtcgaacaatagccaacaagtaaatattttcttagtgcaatcagtggaaacggaaccctagaactcctagaagcgaatgacactgagcgcgaattgtttcaattgatcaacaaatctattatcaacaatacagacgcacaccagttgtaacattatgtatactatactacatttatattctccgcgcaattgcaattaaatattatgaaacattgctactaattcgccgagactgattaaatatgatctcatcacgagactggcccgcactggcttgcctcagctattccttaaccatgggttaaaaataaaacaaactatttttatgaaacgtccagattgcggcgctagtttcctactgatcgccaaagtacaaatccatcaatagtatctgtatgacgtgtaatggcaaggttacatgtagttgtaggtatatttttttataacaaaagtcgagataaaattccgtataagtacataatttttatgttttacgtggttttatcgaaatagaattataatcgtagataagtgatatttagttttgatagtattgttattatttttattgtgcaaactattcgtgttgcgccaaccactcttacagggaatgtttagtttcagtactctagaacataatattaatacttattgatgctaaattagacgaatactcaaacagctagtttcactgtacggtaacacaatcgattttgattccctgtagccttgatcctgaccttggttgcggcaaacacggcaaacaccacgtgggatacatttcataaacacaggcgactcgtactcgcaaacaaaactaaaatagaccatatccgcatacctacctaaaatatgttcaggacgcttttgaattacgctagttgtcctgaaaaaaggactaaagatatatacgggtatcttgcacaccattgtgcacgtgttttgtcataccatgaatttgaatcaatttagaaatataggtataagtagacttttgtgttccaaaattaatcgcctttaataggtttatagctataatttgtttatcatttcattacaacagacagttttgtttaatctattacctacctactagctttcctacatccctattatattttttacgtacaaagttcatttgactatattttttgatgatagaggtaatttaaaatctgtttatgagatcaatcgacttgtatttgctaaaatttagctacgttttatacttcggaccactgccacctggccactattgttacgcatttaccttaaacttaatagttaatacgctttacatatgtcttttaattgtattgtatttattacaggagttcagaaccatctgaagccaaggctgaggaagtaccaag

SEQ ID NO: 346 - DNA, 1933 bp, Spodoptera frugiperda;
gatcattaagacccgccagagctgcgtaaaacaaacaaactttcgcgttatttcgcgccgactttcaaactatttgtagcttttcacacttcaagggaacttgtcggccattgacgcacttacactgttctaaaccaaacgttgtattataatcgagtttcagttctacagcacctttcacgttttatcgacctgataaattgataacgtatcatggatgcgttagtcgcgattgggaggaccgcggataaacgtttcagccgatatatacggctgacttaattcattgtgaattagtataatgagtttttaaacacagtagctgtctgtagttgtagtgtggcctgttgttgtgtgaataattcagttaattaattgttcaaaatgaaggactcgaagggaaacgcgtggcaattgaaaccaggggaaaaggagaacgagaataaattaccagacccattgaatgaagatgtacagaaaggacaattctctgacacgtaagtttaccttgttattgcatattattatttataccaatgtaaacaatctgttgattgtcgaacaatagccaacaagtaaatattttcttagtgcaatcagtggaaacggatccctagaactcctagaagcgaatgacactgagcgtgaattgtttcaattgatcaacaaatctattatcaacaatacagacgcacaccagttgtaacattatgtatactatactacacttatattctccgcgcaattgcaattaaatattatgaaacattggactaattcgccgagactgattaaatatgatctcatcacgagactgggccgcactggcttgcctcagctattccttaaccatgggttaaaaataaaacaaactatttttatgaaacgtccagattgcggcgctagtttcctactgatcgccaaagtacaaatccatcaatagtatctgtatgacgtgtaaatagcaaggttacatgtagttgtaggtatatttttttataacaaaagtcgagataaaattccgtataagtacataaattttatgttttacgtggttttatcgaaatagaattataatcgtagataagtgaatatttagttgtgatagtattgttattatttttattgtgcaaactattcgtggtgcgccatccactcttacagggaatgttttgtttcagtacactagaatataatattaattcttattgatgctaaattagatgaatactcaaaatgaaaaagctagtttcgctgtacggtaacacaatcgattttgattccctgtagccttgatcctgaccttggttgtggcaaacaccacgtgggatacatttcataaacacaggcgagtcgtactcgcaaacaaatctaaaatagaccatatccgcatacttaggtataatatttttatgacgctattgaattacgctaattatcgtgaaaaaaggactgaagatatgggtgtcttgcacaccattgtgcacgcgttttgtcattaagaaaataccacaaatttgaatctatgtagaaatatataagtagacttttgtgttccaaaatttaatcgcctttaataggtttatggctataatttgtttatcatttcattacaacagacagtcttgtttaatctattacctacctactagctttcctacatattatattttttacgtacaaagttcatttgactaaattttttgatgatagaggtaatttaaaatctgtttatgagatcaatcgaatcttgtatttgcgaaaattaagctacgttaatacattttatacttcggaccaccgccaccggacctctgttgttacgcatttaccttaaacttaatagttaatacgttttactatgtcttttaattgcattgtatttttgcaggagttcagaaccatctgaagccaaggctgaggaagtaccaag

SEQ ID NO: 347 - DNA, 2528 bp, Spodoptera frugiperda;
gcagctctaaaccaggactttggatactttgatgttcataaaaatgcagaaatagcaaacaaaatgaacaggtacagtttattattaaacagagtttacttaataattagacagaaattatgaagtaactaattgaacatattaaatatattctaagtcggagactacaagttcgaggaaactttttaatttctccaatattgtgatgtgttttgaaagatgtagtctcataaagtctatttgtaattatttatttattcattcatggtataccaacagcttctgtataaatggtattaagtacaataaatacatataaatcactttcgggcttatacagttagtcattgaaaattaattggatctacatctcacagtgatataatgaagctggaagaaggtatcggagagaagttagcgaccttcttcttctaccaggcttcgttcttgagcagtgtgatcatggcgctggtcaaaggttggaagcttgctctgctgtgcctcatctccttcccggttaccatgacccttgtaggcgttgctggattggtgagttctgatattatatggaattttattagttgtctgtacccactaggtaaaactagggaaccctattactaaggatgtccgtccaactgtcaccaagctgtacctatttcatgaaccgtgatagccagacagttgaagggaaaaatggtgatagttttatacactatggggactccggagcaggtctattagaggacctggtgtccctttaaggagctgagggtggctaacgggttggttttagtgaggtaaaaaccccacactccctagtcttttatccccagaaagctaggggccttttgaagtttgcccccaaggtatatcacgtatagaccttcaaacgatactagatacgtaattattatacaattacaatcataaagaaaaactatcaccattgtgttatttgtgtcgcttagatccgcgttaaactgatagttgataccgaaagtcaataaatagatactcgaaaaagataactgatactaggtatataattaggatttaaaagtacctaacttggactgtatcgaccaatccgtggagtagatacatagatattggaatttaataaaaaaaagttgatactattttaaaatatcttgctaaaaatatgaaaaaagaaatgtttagtcattccttatctcagtttaagattggaacaagtccggctttcccgaaaactttacgtaatggcgaacacagcagagcacgtattagggcttatatgtataagggcacgtataagggcctattaaaataatgagcttaatttaaacgaggtgatactcaaatgtaagaatttagaaatacgtacctaattgtattatactttatcgtaaaaacgatagaaaatattaactctccttcttaaatgattcaaaaatacttggatctaaagtatactatgtaaggtactatatgcgtccgttaaaagacaaaaatgttcaataattacgaaaactaattagtaaacgtaactttttatgagtgtagtttactccttgagttataatgtaaaattatttatgtcttcaacagttcccacacaaggtaactaataattaaacatttcccaacagatagctgcaagtctttcaaagaaagaagctatagcgaccggtaaggcaggtgctatcgctgaagaggtgatatctgccatccgcacagtgtacgccttcagtgggcaggagaaggagctcgacagatacgagggacatctcaatgatgccaggaagatcaatgttaagaagagtaagtgtttctttgaaaccaaaatttttttcagtctagtttggtaatgatcctaattccaagaatgtgactaacaggcacatcaagatcctctatacattgccaatacatttccaactttattgcaactttattaaggttaaaaatctattaaataaatattactaaatggtatatcttaatgcactggtatcttctatagatatgactgacaaaatcttctttcaggtttgttcaacggtctggcaatgggttgcctgttcttctgcatattctgcgcatacgcactctccttctggttcggttacagactgatggtaactgatggatacgacgtttctaccatgattgctgtaagtaaactatttattttatactttgttatttttgtatgatctccacctttataagtaaatacggcaatgggctaatttaacagaataataatatattgattttgataacatctacgacttttaactaactacagacaacgttcggcgctctgattggtgggtttattcgagcaggccaatcagatcgtcgaacgcgctcctcgttccgattactttaaacgtaaagcaaacttgtaaagggtacagataaggcagaactagtttcgataaaatttaaacgtaaactcgtactaagggtacagatagggcagaaacctaatatagtttatttaatccctaggtattcttcggtgtaatgactggttc

SEQ ID NO: 348 - DNA, 2766 bp, Spodoptera frugiperda;
gccgctctaaaccaggactttggttactttgatgttcataaaaatgcagaaatagctaacaaaatgaacaggtacggtttacttaatactaagacagaaattatgaagttactaattgaacaaaagatattaggtaagctacgatttcgaggaaacctcttaatttctacgatattgtgatgtgatttggaaaatgtagtttcaaagtgattaaaaaagagagtaaatttttttttaatgcatgaatagagtcactatttgtagcaattgaatgttaattggaaccttatctcgcagtgatataatgaagctggaagaaggtatcggagagaagttagcgaccttcttcttctaccaggcttcgttcttgagcagtgtgatcatggcgctggtcaaaggatggaagcttgctctgctgtgcctcatctcattcccggtcaccatgacccttgtaggcgttgctggattggtaagtcctgattataattttattatgtttcggtaccctctgggtaaaatgggaaccctattactaagacttcgccgtacaacttccaacttgttaccatgctttatctcatgaaccgtgatagccagacagttgaaaggaaaaatggtgataggtttaagtatacactaatgggggctccggggtaggtctaatagaggacccggtgccccttacaggtgctgagggttgccagcgggtggttttagtgagataaatatcccacactccctagtcgtttatccccagaaacctaggcgcctccagaagatttccgccgtcataaaaaaaaagttttatacactaggattttctcctgtgtccacttaccagtttatcacgtatagacgttcaaacgatactagatacgtaattgttatacaattacaatcataaaaaaataatactatcaacattgtattatttgtgtcgcttagatccgcgttaaactgatagttgataccgaaagtcaataaatagatactcgaaaatgataactgatactataggtatagttaggatttataagtacctaacttggactatagcgaccaatccgtggagtagacacatagatattggaattaaaaaagttgatacaattttaaaacaaaatgaaaaaagacatataacaaagcatgatgataactaagcatttcccaacagatagcagcaagtctttcaaagaaagaagctatagcaaccggtaaagcaggcgctatcgctgaggaggtgatatctgccatccggactgtgtatgccttcagtgggcaggagaaggagctcgacagatacgagggacatctcaatgatgccaggaagatcaatgttaagaagagtaagtgtttcttttaacacattgaaccgttgtgatcaccagtggccgactttagcgaaggatttgccttcaacatttttctattggcagtcaaagacttaacctaaatcttattcagactattttaacaatggacctaatccatggagctaaaaggtacctataaagagcagatgtcataactggatttccctttaaaattatgcgtgacactttacgtggagcgcgggacgttacaaacgacccctctctattttacaacttgcattcctatactacaaacacgctgccaattgtccacattttaatgtggcactttctgacctatctacacctttttacttataatatcattgggcttcccttttgttttgtcagagtgtataaataaataaaaacacacaaaggtcctctacacatcgccaatacatttccaactttattgcgaccaagttaaggttacaaatctattaaacaaagtttacaaaacggtatatcttaatcttctgtagatatgactgacaaaatcttctttcaggtttgttcaacggtctggccatgggttgcctgttcttctgcatattctgcgcgtacgcactctccttctggttcggttacagactgatggtaactgatggatatgatgtttctaccatgattgctgtaagtaaactatttatttcatacgttgttagtttttatggcattcaacattagaagtaaatgcgacaaagggctaaattaacacaatattaccatgttaattttgatatcgtcgacgacttttaaccaactacaaacattatgaacagacagcattcggcgctctgattggttggtttattcgagccagcgaatcagagcgccgaacgcgctctcgtttaaactttaaagcaaactcgtactaagggtacagatagggcagaaacctaataaagtttatttaatccccaggtattcttcggtgtgatgactggttcacgcactctccttctggttcggttacagactgatggtaactgatggatacgacgtttctaccatgattgctgtaagtaaactatttattttatactttgttatttttgtatgatctccacctttataagtaaatacggcaatgggctaatttaacagaataataatatattgattttgataacatctacgacttttaactaactacagacaacgttcggcgctctgattggtgggtttattcgagcaggccaatcagatcgtcgaacgcgctcctcgttccgattactttaaacgtaaagcaaacttgtaaagggtacagataaggcagaactagtttcgataaaatttaaacgtaaactcgtactaagggtacagatagggcagaaacctaatatagtttatttaatccctaggtattcttcggtgtaatgactggttc

SEQ ID NO: 349 - DNA, 2859 bp, Spodoptera frugiperda;
actcaggctgcggcaagtccaccatcatacaactcatctccagattctacgacgtcgtcgaaggaagtgtaagtagctagcttttgcaattaattgtgtttttctgttcaatatttgcgctaactagatggcgccactagcggaaaaagctaatcattatttttatcaaacgttacacttgccaaataaagcatagttcgcagtagacagtggaatatatatctatgagatctagctgtctgcttgtttcatagcaaaatatcaaacgaggtagcccaattacttacagcaaaaataaaattggaagcaaaactccttctaataacttgtaactatggcagcaattcgtgagaatgaatgtagaaagtatctaatgatacctattgatatgttgttactaaatacgcgtgtactacctacataactttagatgttatgtaggtaaaattagaatggctgacgcaatgacggaaggggtttcgtcgaccattttgtcaataatctgatacacgcgtgtttaatgaaattgatgctctattataattttattaccgttgtaatttatttaaccgtaattgtatatggtcaaataaaattattaaggactacagatacaagacaatttgaccctatatgaccgaaatgggactcatggaatggaaatatttttttttgtgtattttaaatttcactataaagtttcgatcttttattaccaccacaagaagcacagtaagccaatctggcaattatattactatacctacatagagacttgtaactatcaaaaatggaactttcaaattcaaaatcttagcaatccaccaacatttcttaatccaaagtcaaagtcaaagcatttatttcaattaatcctaaattaggcacttttgaaacgtcaaattgaattgtccgtcagtctgtctgtcagtgaagctaggcgctcgttccaaagtgttgtttcgaatggagaagaacgagcaagaaactccatcgttactcttttcaaaaaatgttttttacaatatctctgatacattatttgatcatttacctattgtatatatatgtaggaacaatgtaacgacaatacgacgtcaaaactatgggacaataaaaccaatttgtaaagaatataaatgaaaaaagcgggttgtttcaaacatagtgcccacatatgtacacttacaattttgaaataatgcttctatacaaataaaaaataatctttaatttaatttttcaaaatatatataataataaataactgcttgatgccacaggatccctagactacattggaataaattagtactttaatttaacgtgtaactagtgatcgtattagagcattgtctagtgtgagcgagtgtccagtggagccggaccaacatgctgccacacatttttaacttcaatataatctgacagtttataatatgcctgtttacacagttcacgctttatacaagatttaatttttttctcgttcagattcagtatggtggttggtagtttattgtaacacttaacacaaaatcccatgaaggatttctgcactttggacaatcggaattgcggtatagctaacttatttttacctctcgtattaaaattgtgtctgtcgcttcttttttcaaacaattgttgattttttctcacgtacaaaacattcatacttaggtcgcaatcgacggtaatgacgtccgcgacctatcagtccgttggctccgcgagcagatcggcctagtaggccaggagcccgtcctattcaacactaccgtccgggagaacattcgctacggacgtgagaacgccaccaatgaggagatcgaagcctgcgccagacaagccaatgcacaccagttcatcatgaaactgccgaaggtaagctttatattgtcctaggtcctattaaaataaacagcaaaaaatttaggtataagcaactgtctttctacaggacataagccacttgtcgtaccaaaaaaagagacgttaatcaccagcaggattgtattttaatcataaattacctagtcaggaattttattgaagcacaaattatctacgacactttctgtaaatgtctctgttaccatataattgcaaacaaactgaggaataggtaaggtaactgatgtgaaagtaaaatttactatggtagggttacgacacactggtgggagagcgtggagcgtcactgtcaggtggtcagaaacaacgtatcgccatcgctcgagctttggtacggaacccgaagatattgctactggatgaggctaccagcgctctcgacacctcttctgaagccaaagtacagaaagcacttgataaggtaatattttagaactttatttctagattttgttacttcttgaaacataaataggcactaataaaaattattcaatgataccctgaagctatcagttaacaagaatagtttagtaaaatatttgttaatatttatgctttttattcgcgtcattctattatgataatactcgactagtttcaaacctaactggagcccttaattaactctacattaatcgagcatgcccatttcttatgttgtgtgcacagcgatgttgggctaacaatacctattataatatttatatttaatctcattataaaattaaattatccatctcataggcacaagaaggtcgcacaacaatagtggtggctcacagactgtccacaatcaggaacgtcgatgtgatatacgtgttcaaggcgggtttggtggtggaatgtggcaaccacacagaactgatggcaagcaagggacactactacgatatggtgatgctgcagaacctgcctggcgtggatgagcagtcgcctggt

SEQ ID NO: 350 - DNA, 2819 bp, Spodoptera frugiperda;
actcaggctgcggcaagtccaccatcatacaactcatctccagattctacgacgtcgtcgaaggaagtgtaagtagctagcttttgcaattaattgtgtttttctgttcaatatttgcgctaactagatggcgccactagcggaaaaagctaatcattatttttatcaaacgttacacttgccaaataaagcatagttcgcagtagacagtggaatatatatctatgagatctagctgtctgcttgtttcatagcaaaatatcaaacgaggtagcccaattacttacagcaaaaataaaattggaagcaaaactccttctaataacttgtaactatggcagcaattcgtgagaatgaatgtagaaagtatctaatgatacctattgatatgttgttactaaatacgcgtgtactacctacataactttagatgttatgtaggtaaaattagaatggctgacgcaatgacggaaggggtttcgtcgaccattttgtcaataatctgatacacgcgtgtttaatgaaattgatgctctattataattttattaccgttgtaatttatttaaccgtaattgtatatggtcaaataaaattattaaggactacagatacaagacaatttgaccctatatgaccgaaatgggactcatggaatggaaatatttttttttgtgtattttaaatttcactataaagtttcgatcttttattaccaccacaagaagcacagtaagccaatctggcaattatattactatacctacatagagacttgtaactatcaaaaatggaactttcaaattcaaaatcttagcaatccaccaacatttcttaatccaaagtcaaagtcaaagcatttatttcaattaatcctaaattaggcacttttgaaacgtcaaattgaattgtccgtcagtctgtctgtcagtgaagctaggcgctcgttccaaagtgttgtttcgaatggagaagaacgagcaagaaactccatcgttactcttttcaaaaaatgttttttacaatatctctgatacattatttgatcatttacctattgtatatatatgtaggaacaatgtaacgacaatacgacgtcaaaactatgggacaataaaaccaatttgtaaagaatataaatgaaaaaagcgggttgtttcaaacatagtgcccacatatgtacacttacaattttgaaataatgcttctatacaaataaaaaataatctttaatttaatttttcaaaatatatataataataaataactgcttgatgccacaggatccctagactacattggaataaattagtactttaatttaacgtgtaactagtgatcgtattagagcattgtctagtgtgagcgagtgtccagtggagccggaccaacatgctgccacacatttttaacttcaatataatctgacagtttataatatgcctgtttacacagttcacgctttatacaagatttaatttttttctcgttcagattcagtatggtggttggtagtttattgtaacacttaacacaaaatcccatgaaggatttctgcactttggacaatcggaattgcggtatagctaacttatttttacctctcgtattaaaattgtgtctgtcgcttcttttttcaaacaattgttgattttttctcacgtacaaaacattcatacttaggtcgcaatcgacggtaatgacgtccgcgacctatcagtccgttggctccgcgagcagatcggcctagtaggccaggagcccgtcctattcaacactaccgtccgggagaacattcggtatggacgtgagaatgccactaatgaggagatcgaagcctgcgccagacaagctaatgcacaccagttcatcatgaaactgccgaaggtaaattctatattgtcctaggtcctatgaaaataatcagcaaaaattttaggtataagcaactgtctttctacaggacataaaccacttgtcgtacgaaaaaaagagacgttaatcaccagcacgattgtattttaatcataaattacctattcagaaattctgttgaagcccaaattatgtacgacactatctgtaaatgtctctgttaccgtataattgcaaacaaaccgatgaataggtatcagttaaagttaaatttactatggtagggttacgacacactggtgggagagcgtggagcgtcactgtcaggtggtcagaaacaacgtatcgccattgctcgagctttggtacggaacccgaagatattgctactggatgaggctacctccgccctcgacacctcttctgaagccaaagtacagaaagcacttgataaggtaatatttatgcaccttatttctagattttgtaattttttcaaacttaaatacgtactaataaattttattcagtaacaccctgatgctatcagttaacaagaatagtttaatgaaatatttgttaatattttactactcgactagtttcaaacctaactggagctcttaattaactccacattaatcgagcatgcctaatttttatgttgtgtacacaccgatattaggccaacaatacccattataacatttatgtttaatctattataaaataaatgatctatcttacaggcacaagaaggtcgcacgacaatagtggtggctcacagactgtccacaatcaggaacgtcgatgtgatatacgtgttcaaggctggtttggtggtggaatgtggcaaccacacagaactgatggccagcaagggacactactatgatatggtgatgctgcagaacctgcctggcgtggatgagcagtcgcctggt

SEQ ID NO: 351 - DNA, 1310 bp, Spodoptera frugiperda;
ggctacaggtcaaagaatcggtacagtggtacaggcagttggtacattcggcttcgcgctggtactgtccctgatcttcgagtggcgagtgggtctggtggcgctgacgttcgtgcccatcatcatattcgtgctgtacaaggagggccggatgacttacgccgctacttctggcaccgtcaaggtcatggagactagttctaaggtaaatactaaaatgcttttctatagattgtggaaaacgatgaatttaatttttttttaagtgttactgtttttaaagtacatagagctatgccctgttgcttttaaaaaaataatagccaaataatgtttcacgtgaacgtgtagcgggttcgattcccgtacgaagcaaatctttgtgtctgggtgtcatgtgaagaacaacacaggagaaaatactagagtgtggcaacggtttttaaaagaaaaaaaaagtctgtctctacataactaagattaccataataccttagcaggtaggttggtgattacagttttaaaagagtcagattagtatttataaatcatcaaaaatgagcactaacttcaacacaaaatggcattacagatagccgtagaagccgtggccaacgtccgaacagtggcgtctctgggtcgcgaggagacgttccgtcgcgagtactcgaagcagctgcggccggcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtgagttttgtagactatttaggtttaggttttattttgtttcctgtttttattatgttgttatgtaaaaaagatagtttggtttaccgctatgaaaataatgtatcacaaagcacaaaagttacattgttttacctgctgttttaaccacaaaagataattaaaattattaacagatttttttatatgttatgatttatggctcaatctggatttttttttcattttcgacgtaactcgactattttcaagtcatgcttggagcttactcgtgagcagcattgcgctatattttttttttaaattactatgaatattttgttacaaaaatagatttgttcaacatttctgtctgcaaatgatcatttagctttatctctaaccgtcgtacaggtcagctcaagcgctattgatgggcgctacgtccgcggcgcaggcgtttgccttcgctcccaacttccagaagggcatcaagg

SEQ ID NO: 352 - DNA, 1318 bp, Spodoptera frugiperda;
ggctacaggtcaaagaatcggtacagtggtacaggcagttggtacattcggcttcgctctggtactgtccctgatcttcgagtggcgagtgggtctggtggcgctgaccttcgtgcccatcatcatattcgtgctgtacaaggagggccgcatgacttacgccgctacttctggcaccgtcaaggtcatggagactagttctaaggtaaacactaagattttgtataaattggggagaaacgctaacttacatttatcaaagagtttttaaagtaggtagagttatgctctcctgcttttaaataaattcttgactcgaagtttggtgcggtggttggcaaaatggctggagacgtgtagcgggttcgattcccgcactgtgcaactctttgtgtgatccgcaaattgttgtttcgagtctggatgtcatgtgtatgtgaacataattgtatgtttgtaaatgcacccacgacacaggagaaaatcctatgtggggcaacgtttttttaaagaaaaaaaaatctctacatatctaagatttccataatagcatagcaggtaggttggtgattacagttttaaaagagtcagcttagtatttatcaaaaaccactactgtctgagcactgacatcaacacaaaatggcattacagatagccgtagaagccgtggccaacgtccggacggtagcgtcgctgggtcgcgaggagacgttccgtcgcgagtactcgaagcagctccgtcctgcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtaagtcttgtagactatatgtgttgattaactaggttttattttgtttcctgtttttaattttgttgttatgtaaaaattacatttttgatttaccgctttgaaaataatgtgtcacaataggtatgtatattgttttacccagtgttttacctacaaaagataattaaaattattaacaatttttttttgtgatttatggctcactcactcacttgattgttttgtttttaacgtaactcgactactttcaagttacgcttggacctcactcgtgagcagcattgcgcgataaaccgaacaaataatcatttgactttatctctaaccctcgtataggtcagctcaagccctattgatgggtgctacgtcagcggcgcaggcgtttgccttcgctcccaacttccagaagggcatcaagg

SEQ ID NO: 353 - DNA, 1273 bp, Spodoptera frugiperda;
ggctacaggtcaaagaatcggtacagtggtacaggcagttggtacattcggcttcgctctggtactgtccctgatcttcgagtggcgagtgggtctggtggccctgaccttcgtgcccatcatcatattcgtgctgtacaaggagggcaggatgacttacgccgctacttctggcaccgtcaaggtcatggagactagttctaaggtaaataccaaaacgcttttgtatagattggggagagagagagagagagatatgctttcctgcttttaaaaaaaagtcaaataatgtttgactgcaagtttggtgcggtggctcggcaaccggctgccatgtcatgtgtagcgggttcgattcccacacgtagcaactccttgtatgatcaacaaattgttgtttaattattagtgaatcccaatgaaactctttttctgatctttgataaatatcaaagatctctgcttagtcatctcttacgacatgcaagaagaatagaaaatcctacttttctatcacaacaacacgcatacctactgaccactgacttctacacaaaatggcattatagatagccgtagaagccgtggccaacgtccggacagtagcgtcgctgggtcgcgaggagacgttccgtcgcgagtactcgaggcagctgcggccggcgctggacacggccgtgcggtcctcccactggcgcggcctcgtgttcggcatgtcgcgcggagtcttcaacttcgtcatcgccagctcgctgtactacggcggaaccatcatcgtcaacgaaggcgtgcctttcgaacaagtcttcaagtaagttctgtagactatatgtgttgactaactaggttttattttgttccctgtttttaattttgttgttatgtaaaaatatcaattgttaaaccactttgataattaaagtatattgttttacctactgttttaaccacaaaggatatgtaaaattagtaatagtttctttttgttatgatttatggctcaatctggaaattgttttcattttcgacgtaactcgactattttcaagtcatgcttggagctcactcgtgagcagcattgcgctatatttttttttaaattactatgaatattttgttacaaaaataggttttttcaacatttctgtctgcaggtgagcattaactttatatatgtaatcttcgtacaggtcagctcaagccctattgatgggtgctacgtcagcggcgcaggcgtttgccttcgcccccaacttccagaagggcatcaagg

SEQ ID NO: 354 - DNA, 149 bp, Spodoptera frugiperda;
gactcgaagggaaacgcgtggcaattgaaaccgggggaaaaggagaacgagaataaattaccagacccattaaatgaagatgtacagaaagggcaattctctgacacgagttcagaaccatctgaagccaaggctgaggaagtaccaag

SEQ ID NO: 355 - DNA, 155 bp, Spodoptera frugiperda;
atgaaggactcgaagggaaacgcgtggcaattgaaaccaggggaaaaggagaacgagaataaattaccagacccattgaatgaagatgtacagaaaggacaattctctgacacgagttcagaaccatctgaagccaaggctgaggaagtaccaag

SEQ ID NO: 356 - DNA, 566 bp, Spodoptera frugiperda;
gcagctctaaaccaggactttggatactttgatgttcataaaaatgcagaaatagcaaacaaaatgaacagtgatataatgaagctggaagaaggtatcggagagaagttagcgaccttcttcttctaccaggcttcgttcttgagcagtgtgatcatggcgctggtcaaaggttggaagcttgctctgctgtgcctcatctccttcccggttaccatgacccttgtaggcgttgctggattgatagctgcaagtctttcaaagaaagaagctatagcgaccggtaaggcaggtgctatcgctgaagaggtgatatctgccatccgcacagtgtacgccttcagtgggcaggagaaggagctcgacagatacgagggacatctcaatgatgccaggaagatcaatgttaagaagagtttgttcaacggtctggcaatgggttgcctgttcttctgcatattctgcgcatacgcactctccttctggttcggttacagactgatggtaactgatggatacgacgtttctaccatgattgctgtattcttcggtgtaatgactggttc

SEQ ID NO: 357 - DNA, 566 bp, Spodoptera frugiperda;
gccgctctaaaccaggactttggttactttgatgttcataaaaatgcagaaatagctaacaaaatgaacagtgatataatgaagctggaagaaggtatcggagagaagttagcgaccttcttcttctaccaggcttcgttcttgagcagtgtgatcatggcgctggtcaaaggatggaagcttgctctgctgtgcctcatctcattcccggtcaccatgacccttgtaggcgttgctggattgatagcagcaagtctttcaaagaaagaagctatagcaaccggtaaagcaggcgctatcgctgaggaggtgatatctgccatccggactgtgtatgccttcagtgggcaggagaaggagctcgacagatacgagggacatctcaatgatgccaggaagatcaatgttaagaagagtttgttcaacggtctggccatgggttgcctgttcttctgcatattctgcgcgtacgcactctccttctggttcggttacagactgatggtaactgatggatatgatgtttctaccatgattgctgtattcttcggtgtaatgactggttc

SEQ ID NO: 358 - DNA, 636 bp, Spodoptera frugiperda;
actcaggctgcggcaagtccaccatcatacaactcatctccagattctacgacgtcgtcgaaggaagtgtcgcaatcgacggtaatgacgtccgcgacctatcagtccgttggctccgcgagcagatcggcctagtaggccaggagcccgtcctattcaacactaccgtccgggagaacattcgctacggacgtgagaacgccaccaatgaggagatcgaagcctgcgccagacaagccaatgcacaccagttcatcatgaaactgccgaagggttacgacacactggtgggagagcgtggagcgtcactgtcaggtggtcagaaacaacgtatcgccatcgctcgagctttggtacggaacccgaagatattgctactggatgaggctaccagcgctctcgacacctcttctgaagccaaagtacagaaagcacttgataaggcacaagaaggtcgcacaacaatagtggtggctcacagactgtccacaatcaggaacgtcgatgtgatatacgtgttcaaggcgggtttggtggtggaatgtggcaaccacacagaactgatggcaagcaagggacactactacgatatggtgatgctgcagaacctgcctggcgtggatgagcagtcgcctg

SEQ ID NO: 359 - DNA, 636 bp, Spodoptera frugiperda;
actcaggctgcggcaagtccaccatcatacaactcatctccagattctacgacgtcgtcgaaggaagtgtcgcaatcgacggtaatgacgtccgcgacctatcagtccgttggctccgcgagcagatcggcctagtaggccaggagcccgtcctattcaacactaccgtccgggagaacattcggtatggacgtgagaatgccactaatgaggagatcgaagcctgcgccagacaagctaatgcacaccagttcatcatgaaactgccgaagggttacgacacactggtgggagagcgtggagcgtcactgtcaggtggtcagaaacaacgtatcgccattgctcgagctttggtacggaacccgaagatattgctactggatgaggctacctccgccctcgacacctcttctgaagccaaagtacagaaagcacttgataaggcacaagaaggtcgcacgacaatagtggtggctcacagactgtccacaatcaggaacgtcgatgtgatatacgtgttcaaggctggtttggtggtggaatgtggcaaccacacagaactgatggccagcaagggacactactatgatatggtgatgctgcagaacctgcctggcgtggatgagcagtcgcctg

SEQ ID NO: 360 - DNA, 529 bp, Spodoptera frugiperda;
gctacaggtcaaagaatcggtacagtggtacaggcagttggtacattcggcttcgcgctggtactgtccctgatcttcgagtggcgagtgggtctggtggcgctgacgttcgtgcccatcatcatattcgtgctgtacaaggagggccggatgacttacgccgctacttctggcaccgtcaaggtcatggagactagttctaagatagccgtagaagccgtggccaacgtccgaacagtggcgtctctgggtcgcgaggagacgttccgtcgcgagtactcgaagcagctgcggccggcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagcgctattgatgggcgctacgtccgcggcgcaggcgtttgccttcgctcccaacttccagaagggcatcaagg

SEQ ID NO: 361 - DNA, 529 bp, Spodoptera frugiperda;
gctacaggtcaaagaatcggtacagtggtacaggcagttggtacattcggcttcgctctggtactgtccctgatcttcgagtggcgagtgggtctggtggcgctgaccttcgtgcccatcatcatattcgtgctgtacaaggagggccgcatgacttacgccgctacttctggcaccgtcaaggtcatggagactagttctaagatagccgtagaagccgtggccaacgtccggacggtagcgtcgctgggtcgcgaggagacgttccgtcgcgagtactcgaagcagctccgtcctgcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagccctattgatgggtgctacgtcagcggcgcaggcgtttgccttcgctcccaacttccagaagggcatcaagg

SEQ ID NO: 362 - DNA, 529 bp, Spodoptera frugiperda;
gctacaggtcaaagaatcggtacagtggtacaggcagttggtacattcggcttcgctctggtactgtccctgatcttcgagtggcgagtgggtctggtggccctgaccttcgtgcccatcatcatattcgtgctgtacaaggagggcaggatgacttacgccgctacttctggcaccgtcaaggtcatggagactagttctaagatagccgtagaagccgtggccaacgtccggacagtagcgtcgctgggtcgcgaggagacgttccgtcgcgagtactcgaggcagctgcggccggcgctggacacggccgtgcggtcctcccactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagccctattgatgggtgctacgtcagcggcgcaggcgtttgccttcgcccccaacttccagaagggcatcaagg

SEQ ID NO: 363 - DNA, 21 bp, Spodoptera frugiperda;
gactcgaagggaaacgcgtgg

SEQ ID NO: 364 - DNA, 21 bp, Spodoptera frugiperda;
ggtcaccatgacccttgtagg

SEQ ID NO: 365 - DNA, 23 bp, Spodoptera frugiperda;
ggactgtgtacgccttcagtggg

SEQ ID NO: 366 - DNA, 23 bp, Spodoptera frugiperda;
gcgcgtacgcactctccttctgg

SEQ ID NO: 367 - DNA, 23 bp, Spodoptera frugiperda;
ggacgggctcctggcctactagg

SEQ ID NO: 368 - DNA, 23 bp, Spodoptera frugiperda;
ggcttcagaagaggtgtcgaggg

SEQ ID NO: 369 - DNA, 23 bp, Spodoptera frugiperda;
ggaaccatcatcgtcaacgaagg

SEQ ID NO: 370 - DNA, 24 bp, Spodoptera frugiperda;
gatcattaagacccgccagagctg

SEQ ID NO: 371 - DNA, 23 bp, Spodoptera frugiperda;
gcmgctctaaaccaggactttgg

SEQ ID NO: 372 - DNA, 20 bp, Spodoptera frugiperda;
actcaggctgcggcaagtcc

SEQ ID NO: 373 - DNA, 26 bp, Spodoptera frugiperda;
ggctacaggtcaaagaatcggtacag

SEQ ID NO: 374 - DNA, 24 bp, Spodoptera frugiperda;
cttggtacttcctcagccttggct

SEQ ID NO: 375 - DNA, 27 bp, Spodoptera frugiperda;
gaaccagtcatyacaccgaagaatacc

SEQ ID NO: 376 - DNA, 21 bp, Spodoptera frugiperda;
accaggcgactgctcatccac

SEQ ID NO: 377 - DNA, 23 bp, Spodoptera frugiperda;
ccttgatgcccttctggaagttg

SEQ ID NO: 378 - DNA, 21 bp, Spodoptera frugiperda;
gtgtggcctgttgttgtgtga

SEQ ID NO: 379 - DNA, 27 bp, Spodoptera frugiperda;
ggtaaacttacgtgtcagagaattgtc

SEQ ID NO: 380 - DNA, 22 bp, Spodoptera frugiperda;
gcttgctctgctgtgcctcatc

SEQ ID NO: 381 - DNA, 23 bp, Spodoptera frugiperda;
caactgtctggctatcacggttc

SEQ ID NO: 382 - DNA, 23 bp, Spodoptera frugiperda;
ctttcaggtttgttcaacggtct

SEQ ID NO: 383 - DNA, 25 bp, Spodoptera frugiperda;
agaaacatcatatccatcagttacc

SEQ ID NO: 384 - DNA, 200 bp, Spodoptera frugiperda;
gcttgctctgctgtgcctcatctccttcccggttacccgcttcccggtgtaggcgttgctggattggtgagttctgatattatatggaattttattagttgtctgtacccactaggtaaaactagggaaccctattactaaggatgtccgtccaactgtcaccaagctgtacctatttcatgaaccgtgatagccagaca

SEQ ID NO: 385 - DNA, 64 bp, Spodoptera frugiperda;
gcttgctctgctgtgcctcatctccttcccggttaccatgacccttgtaggcgttgctggattg

SEQ ID NO: 386 - DNA, 200 bp, Spodoptera frugiperda;
gcttgctctgctgtgcctcatctccttcccggttaccatgacccttgtaggcgttgctggattggtgagttctgatattatatggaattttattagttgtctgtacccactaggtaaaactagggaaccctattactaaggatgtccgtccaactgtcaccaagctgtacctatttcatgaaccgtgatagccagacagt

SEQ ID NO: 387 - DNA, 64 bp, Spodoptera frugiperda;; identical to SEQ ID NO: 385

SEQ ID NO: 388 - DNA, 200 bp, Spodoptera frugiperda;
gcttgctctgctgtgcctcatctccttcccggtcaccatgacccttgtaggcgttgctggattggtgagttctgatattgtatgatatttaattaggtgtttgtactctctgggtaaaatggcaaccctattactaagacttcgccgtgcaactgtcaccaagctgtatctgaaatcatgaaccgtgatagccagacagt

SEQ ID NO: 389 - DNA, 202 bp, Spodoptera frugiperda;
gcttgctctgctgtgcctcatctccttcccggtcaccatgacccttgtaggcgttgctggattggtgagttctgatattgtatgatatttaattaggtgtttgtactctctgggtaaaatggcaaccctattactaagacttcgccgtgcaactgtcaccaagctgtatctgaaatcatgaaccgtgatagccagacagttg

SEQ ID NO: 390 - DNA, 3786 bp, Spodoptera frugiperda;
atgaaggactcgaagggaaacgcgtggcaattgaaaccgggggaaaaggagaacgagaataaattaccagacccattaaatgaagatgtacagaaagggcaattctctgacacgagttcagaaccatctgaagccaaggctgaggaagtaccaagcataccttttattacactattcagatttgcatcgacaagggacaaactcttcataatctgcgcgttaatatgttccgcggtcgccgcaatatccacgccactgaacacactgttgcttgcgtacctactcgaagctatggtcaactacagcatctttggtgatgctgatgccttcatgaagtcgttactgaacttcgccatatacaacgcggcagtcggagcggcacttgtggttctgtcttacgctgccactactttgatgaacatcgctgcttataaccaagtatatgtaatacgacaagagtatttgaaagcagctctaaaccaggactttggatactttgatgttcataaaaatgcagaaatagctaacaaaatgaacagtgatataatgaagctggaagagggtatcggagagaagttagcgaccttcttcttctaccaggcttcgttcttaagcagcgtgatcatggcgctggtcaaaggatggaagcttgctctgctgtgcctcatctccttcccggtcaccatgacccttgtaggcgttgctggattgatagctgcaagtctttcaaagaaagaagctatagcgaccggtaaagcaggtgctatcgcggaggaggtgatatctgccatccggactgtgtacgccttcagtgggcaggagaaggagctcgacagatacgagggacacctcaatgatgccaggaagatcaatgttaagaagagtttgttcaacggtctggccatgggttgcctgttcttctgcatattctgcgcgtacgcactctccttctggttcggttacagactgatggtaacagatggatacgacgtttccaccatgattgctgtattcttcggtgtaatgactggttcagccaacttcggtatatcgtcgactctgatggaggtgttcggctcggcccgcggagccggcgctcacatcttcaacatgatcgacaatgtgcccaccatcaaccccctacagaaccggggcactgtgcccagtgatattgagggcaacatcgaactgaagaacgttgagttccactacccatccaggcctgatgttcctgtactaaaaggtgtgagtataaaggtgaagcgcggtcagtctgtggccctggtcggccactcaggctgcggcaagtccaccatcatacaactcatctccagattctacgacgtcgtcgaaggaagtgtcgcaatcgacggtaacgatgtccgcgacctatcagtccgttggctccgcgagcagatcggcctagtaggccaggagcccgtcctattcaacactaccgtccgggagaacattcggtatggacgtgagaatgccactaatgaggagatcgaagcctgcgccagacaagctaatgcacaccagttcatcatgaaactgccgaagggttacgacacactggtgggagagcgtggagcgtcactgtcaggtggtcagaaacaacgtatcgccattgctcgagctttggtacggaacccgaagatattgctactggatgaggctacctccgccctcgacacctcttctgaagccaaagtacagaaagcacttgataaggcacaagaaggtcgcacgacaatagtggtggctcacagactgtccacaatcaggaacgtcgatgtgatatacgtgttcaaggctggtttggtggtggaatgtggcaaccacacagaactgatggccagcaagggacactactatgatatggtgatgctgcagaacctgcctggcgtggatgagcagtcgcctgaaaaaaccaaattgtctcgcgagacttccataatcagtgaaaaagatgacgaagacgagttcttggaattccggaatgatgacaaagaagaggacgcaaccgaagctcccgacatttccttcatgagagtgttgaagctgaacaagccggagtggaagtccgtcaccctggccagcatctgttctctcatgagcggcttctgcatgccactgttcgccgtcatctttggagacttccttgcgttactcgatggcgacgatcctgacgaaattcaaaaaggagtgtcacgattggcgttgatctttgtcggcatcggtgtgttctctggcatcactaacttcattgtggtattcttctacggaatagcaggtgaagcgttgaccaagcggctgcggctgatgatgttcaggaagctgctggagatggacatcgggttctatgacgacaaggacaactccaccggagcactctgcgccagactgtctggagaggcagccgcggtccaaggggctacaggtcaaagaatcggtacagtggtacaggcagttggtacattcggcttcgctctggtactgtccctgatcttcgagtggcgagtgggtctggtggcgctgaccttcgtgcccatcatcatattcgtgctgtacaaggagggccgcatgacttacgccgctacttctggcaccgtcaaggtcatggagactagttctaagatagccgtagaagccgtggccaacgtccggacggtagcgtcgctgggtcgcgaggagacgttccgtcgcgagtactcgaagcagctccgtcctgcgctggacacggccgtgcgctcctcgcactggcgcggcctcgtgttcggcatgtcgcgcggagtcttcaacttcgtcatcgccagctcgctgtactacggcggaaccatcatcgtcaacgaaggcgtgcctttcgaacaagtcttcaagtcagctcaagccctattgatgggtgctacgtcagcggcgcaggcgtttgccttcgctcccaacttccagaagggcatcaaggcagcaggccgtgtcattgtactactgggaagacagtccaagatcactgacccagctgaacctgctgtcaaacacttcaacggtacaggagaagcaagtctgcagggcattcagttcaggtacccgacccggcctctggtgcgcgtactgaaggacctgaacctggagatacagcgcgggaagaccgtggcgctggtgggggccagcggctgcgggaagagcaccgtcatacaactgctcgagaggtactacgatcctgaagacggcattgtggctcaagacggcgtcccgctaccgaagctgaacctagtagacgctcgacgcgcgatcggcttcgtgcagcaagagccgatcctgttcgaccgcaccatcggcgagaacatcgcgtacgggaacaacgaggcgcgcgtctccaacgacgaggtcatcgaggcagcccagcaggccaacatacacaactttatcacgtcactgcctttgggttacgacacaaacatcggatctaaaggcacgcagctatcaggtggacagaagcagagagtggccatcgcgcgcgctctcatacggagacccaagatgttactgctggacgaagccaccagcgcactcgacactgagagcgaaaaggtggtacaagaagcattagataaagcgaaggcaggccgtacgtgtgtgatgatagctcatagactcagtacagtcagggacgctgacgtcatctgcgtcatccacgagggacaggtcgcagaaatggggacacataacgaactactcgaacttaaaggactgtactacaacttaaataggagaggatacgcttaa

SEQ ID NO: 391 - DNA, 3786 bp, Spodoptera frugiperda;; identical to SEQ ID NO: 344

SEQ ID NO: 392 - DNA, 3888 bp, Spodoptera frugiperda;
atgttaacgttcatggaggttccaaggaaaagaaccatggtggaaaccgggagccttgaggaaaggttccggttaataccaaccagcactaataccactccaaacaaggactcgaagggaaacgcgtggcaattgaaaccgggggaaaaggagaatgaaaataaattaccagacccattaaatgaagatgtacagaaaggacaattctctgacacgagttcagaaccatctgaagccaaagctgaggaagtgccaagcataccatttattacactattcagatttgcatcgacgcgggacaaactcttcataatctgcgcgttaatatgttctgcggtcgccgcagtatctacgccactgaacacgctgttgctagcgtacctacttgaggctatggtcaactacagcatctttggtgatgctgatgccttcatgaagtcgttgctaaacttcgccatatacaatgcggctgttggagcggcccttgtggttctgtcatacgctgccactactttgatgaacatcgctgcttataaccaagtatatgtgatacgtcaagagtatttgaaagcagccctaaaccaagactttggatactttgacgttcataaaactgcagaaatagcaaacaaaatgaacagtgatataatgaagctggaagagggtatcggagagaagttagcgacattcttcttctaccaagcttcgttcttaagcagtgtgatcatggcactggtcaaaggatggaagcttgctctgctatgcctcatctccttcccggtcaccatgacccttgtaggcgttgctggattgatagctgcaagcctttcaaagaaagaagctatagcgaccggtaaggcaggtgctatcgccgaagaggtgatatctgccatccgcactgtgtacgccttcagtgggcaggagaaggagctcgatagatacgagggacatctcaatgatgccaggaagatcaatgttaagaagagtttgttcaacggtctggcaatgggttgcctgttcttctgcatattctgcgcgtacgcactctccttctggttcggttacagactgatggtaactgatggatacgacgtttccaccatgattgctgtattcttcggggtaatgactggttcagccaacttcggtatatcgtcgactctgatggaggtgttcggctcggcccgcggagccggcgctcacatcttcaacatgatcgacaatgtgcccaccatcaaccccctacagaaccggggcacagtgcccagtgatattgagggcaacatcgagctgaagaacgttgagttccactacccatccaggcctgatgttcctgtactaaaaggagtgagtataaaggtgaagcgcggtcagtcggtcgcactggtcggccactcaggctgcggcaagtccaccatcatacaactcatctccagattctacgatgtcgtcgaaggaagtgtcgcaatcgacggtaatgatgtccgcgacctatcagtccgttggctccgcgagcagatcggcctagtaggccaggagcccgtcctattcaacactaccgtccgggagaacattcgctacggacgtgagaacgccaccaatgaggagatcgaagcctgcgccagacaagccaatgcacatcagttcatcatgaaactgccgaagggttacgacacactggtgggagagcgtggtgcatcactgtcaggtggtcagaaacaacgtatcgccatcgctcgagctctggtacggaacccgaagatattgctactggatgaggctaccagcgccctcgacacctcttctgaagcgaaagtacagaaagcactcgataaggcacaagaaggtcgcacaacaatagtggtggctcacagactgtccacaatcaggaacgtcgatgtgatatacgtgttcaaggcgggtttggtggtggaatgtggcaaccatacggaactgatggcaagcaagggacactactacgatatggtgatgctgcagaacctgcctggcgtggatgagcagtcgcctgaaaaaacgaaattgtctcgcgagacttccataatcagtgagaaggatgacgaggacgagttcttggaattccggaatgatgacaaagaagaggacgctgccgaagctcccgatatttccttcatgagagtgctgaagctgaacaagccggagtggaagtccgtcaccctcgccagcatctgttctctcatgagcggcttctgcatgccactgttcgctgtcatctttggagacttccttgcgttactcgatggcgacgatcctgacgaaattcaaaaaggagtgtcacgattggcgttgatctttgtcggcatcggtgtgttctctggcatcactaacttcattgtggtattcttctacggaatagcgggtgaagcgctgaccaagcggctgcggctgatgatgttcaggaagctgctggagatggacatcgggttctacgacgacaaggacaactccaccggagcactctgcgccagattgtccggggaggccgccgccgtgcaaggggccacaggtcaaagaatcggtacagtggtacaggcagttggtacattcgggttcgctctggtactgtccctgatcttcgagtggcgagtgggtctggtggccctgaccttcgtgcccatcatcatattcgtgctgtacaaggaaggcaggatgacttacgccgctacttctggcaccgtcaaggtcatggagactagttctaagatagccgtagaagccgtggccaacgtccggacagtagcgtccctgggtcgcgaggagacgttccgtcgcgagtactcgaagcagctgcggccggcgctggacacggccgtgcggtcctcgcactggcgcggcctcgtcttcggcatgtcgcgcggagtcttcaacttcgtcatcgccagctcgctgtactacggcggaaccatcatcgtcaacgaaggcgtgccttttgaagaagtgttcaagtcagctcaagccctattgatgggtgctacgtcagcggcgcaggcgtttgccttcgcccccaacttccagaagggcatcaaggcagcaggccgtgtcatcgttctactgggcagacagtccaagatcactgacccagtggaacctgctgtcaaacacttcaacggtacaggagaagcgagtctccagggcattcagttcagatacccgacccggcctctggtgcgcgtactgaaggacctgaacctggagatacagcgcgggaagaccgtggcgctggtgggggccagtggctgcgggaagagcaccgtcatacaactgctcgagaggtactacgatcctgaagacggcattgtggctcaagacggcgtcccgcttccgaagctgaacctagtagacgcccgacgcgcgatcggcttcgtgcagcaagagccgatcctgttcgaccgcaccatcggcgagaacatcgcgtacgggaacaacgaggcgcgcgtctccagcgacgaggtcatcgaggcagccaagcaggccaacatacacaactttatcacgtcactgcctttgggttacgacaccaacatcggatctaaaggcacgcagctatcaggtggccagaagcagagagtggccattgcgcgcgctctcattcggagacccaagatgttactgctggacgaggccaccagcgcactcgatactgagagcgaaaaggtggtacaagaagcattagataaagctaaagcaggtcgtacttgtgtgatgatagctcacagactcagtacagttagggatgctgacgtcatctgcgtcatccacgaaggacaggtcgcagaaatggggacacataacgaactactcgaacttaaaggactgtactacaacttaaataggagaggatacgcttaa

That which is claimed:

1. A method for identifying compounds that bind to a polypeptide comprising an amino acid sequence having at least 90% sequence identity to the amino acid sequence set forth in SEQ ID NO: 197, said method comprising:
   a. contacting the polypeptide with one or more test compounds; and
   b. determining whether the test compound binds to the polypeptide.

* * * * *